United States Patent
Lombardi

(10) Patent No.: US 11,129,908 B2
(45) Date of Patent: Sep. 28, 2021

(54) GENE THERAPY VECTORS FOR TREATING HEART DISEASE

(71) Applicant: Tenaya Therapeutics, Inc., South San Francisco, CA (US)

(72) Inventor: Laura Lombardi, Redwood City, CA (US)

(73) Assignee: Tenaya Therapeutics, Inc., South San Francisco, CA (US)

( * ) Notice: Subject to any disclaimer, the term of this patent is extended or adjusted under 35 U.S.C. 154(b) by 0 days.

(21) Appl. No.: 17/210,882

(22) Filed: Mar. 24, 2021

(65) Prior Publication Data

US 2021/0252165 A1  Aug. 19, 2021

Related U.S. Application Data

(63) Continuation of application No. PCT/US2021/017699, filed on Feb. 11, 2021.

(60) Provisional application No. 63/047,633, filed on Jul. 2, 2020, provisional application No. 62/976,160, filed on Feb. 13, 2020.

(51) Int. Cl.
| | |
|---|---|
| *C12N 15/79* | (2006.01) |
| *C07H 21/04* | (2006.01) |
| *A61K 48/00* | (2006.01) |
| *C12N 15/86* | (2006.01) |
| *A61P 9/10* | (2006.01) |

(52) U.S. Cl.
CPC ............ *A61K 48/0058* (2013.01); *A61P 9/10* (2018.01); *C12N 15/86* (2013.01); *C07H 21/04* (2013.01)

(58) Field of Classification Search
CPC ................................ C12N 15/86; C07H 21/04
USPC .............................. 435/320.1; 536/23.5, 24.1
See application file for complete search history.

(56) References Cited

U.S. PATENT DOCUMENTS

| | | | |
|---|---|---|---|
| 8,933,048 B2 | 1/2015 | Stelzer | |
| 9,395,354 B2 | 7/2016 | Sun et al. | |
| 10,501,756 B2 | 12/2019 | Carrier et al. | |
| 2016/0108430 A1 | 4/2016 | Carrier et al. | |
| 2016/0340393 A1 | 11/2016 | Schaffer et al. | |
| 2018/0066285 A1 | 3/2018 | Ojala et al. | |

FOREIGN PATENT DOCUMENTS

| | | |
|---|---|---|
| EP | 2 986 712 B1 | 2/2019 |

OTHER PUBLICATIONS

Chamberlain et al., 2016, Geneseq Accession No. BDC71261, computer printout, pp. 1-3.*
Strausberg et al., 2008, GenEMBL Accession No. BC136543, computer printout, pp. 1-7.*
Katz et al., 2009, Geneseq Accession No. AXS14079, computer printout, pp. 1-4.*
Keaveney et al., 2018, GenEMBL Accession No. MH458079, computer printout, pp. 1-2, 5' ITR.*
Keaveney et al., 2018, GenEMBL Accession No. MH458079, computer printout, pp. 1-2, 3 'ITR.*
Mearini et al., 2013, Molecular Therapy-Nucleic Acids, 2, 2102, p. 1-9.*
Doering et al., 2017, US 20170326256 A1.*
Al, J. et al., Characterization of Recombinant Adeno-Associated Viral Transduction and Safety Profiles in Cardiomyocytes, Cell Physiol Biochem., 48(5):1894-1900 (2018) Epub Aug. 9, 2018.
Altschul, S. F. et al., "Basic Local Alignment Search Tool," J. Mol Biol., 215:403-410 (1990).
Altschul, S. F. et al., "Gapped BLAST and PSI-BLAST: a new generation of protein database search programs," Nucleic Acids Research, 25(17):3389-3402 (1997).
U.S. Appl. No. 63/012,703, filed Apr. 20, 2020, Reid et al.
Asokan, A. & Samulski, R. J., "An Emerging Adeno-Associated Viral Vector Pipeline for Cardiac Gene Therapy," Human Gene Therapy, 24:906-913 (2013).
Balaji, S. et al., "Pseudotyped adeno-associated viral vectors for gene transfer in dermal fibroblasts: implications for wound-healing applications," Journal of Surgical Research, 184:691-698 (2013).
Bardswell, S. C. et al., "Distinct Sarcomeric Substrates Are Responsible for Protein Kinase D-mediated Regulation of Cardiac Myofilament Ca2 Sensitivity and Cross-bridge Cycling," The Journal of Biological Chemistry, 285(8):5674-5682 (2010).
Barefield, D. Y. et al., "Experimental modeling supports a role for MyBP-HL as a novel myofilament component in arrhythmia and dilated cardiomyopathy," Circulation, 136(16):1477-1491 (2017). doi:10.1161/CIRCULATIONAHA.117.028585.
Barefield, D. et al., "Haploinsufficiency of MYBPC3 Exacerbates the Development of Hypertrophic Cardiomyopathy in Heterozygous Mice," J Mol Cell Cardiol., 79:234-243 (2015). doi:10.1016/j.yjmcc.2014.11.018.
Behrens-Gawlik, V. et al., "MYBPC3 in hypertrophic cardiomyopathy: from mutation identification to RNA-based correction," Pflugers Arch-Eur J Physiol, 466:215-223 (2014).
Borgeat, K. et al., "Association of the myosin binding protein C3 mutation (MYBPC3 R820W) with cardiac death in a survey of 236 Ragdoll cats," Journal of Veterinary Cardiology, 16:73-80 (2014).
Borgeat, K. et al., "The influence of clinical and genetic factors on left ventricular wall thickness in Ragdoll cats," Journal of Veterinary Cardiology, 17:S258-S267 (2015).

(Continued)

*Primary Examiner* — Shin Lin Chen
(74) *Attorney, Agent, or Firm* — Cooley LLP

(57) ABSTRACT

The present disclosure provides methods and compositions useful for the treatment or prevention of heart disease. In particular, the present disclosure provides a vector comprising a modified troponin T promoter operatively linked to a therapeutic gene product for the treatment or prevention of heart disease, e.g., cardiomyopathy. The gene product may be MYBPC3. The disclosure also provides recombinant adeno-associated virus (rAAV) virions, rAAV viral genomes, and expression cassettes and pharmaceutical compositions thereof. The disclosure further provides methods for treating a disease or disorder, such as heart disease.

17 Claims, 20 Drawing Sheets

Specification includes a Sequence Listing.

(56) References Cited

OTHER PUBLICATIONS

Burridge, P. W. et al., "Chemically Defined Culture and Cardiomyocyte Differentiation of Human Pluripotent Stem Cells," Curr Protoc Hum Genet., 87:21.3.1-21.3.15 (2016). doi:10.1002/0471142905.hg2103s87.
Carrier, L. et al., "Asymmetric septal hypertrophy in heterozygous cMyBP-C null mice," Cardiovascular Research, 63:293-304 (2004).
Carrier, L. et al., "Cardiac myosin-binding protein C (MYBPC3) in cardiac pathophysiology," Gene, 573:188-197 (2015).
Carrier, L. et al., "The ubiquitin-proteasome system and nonsensemediated mRNA decay in hypertrophic cardiomyopathy," Cardiovascular Research, 85:330-338 (2010).
Chen, X. et al., "Human Cardiac Troponin T Regulatory Cassettes Facilitate High-Level Transient Expression in Differentiating Skeletal Muscle and Continuous Expression in Cardiac Muscle," Molecular Therapy, 19(1)36:S14 (May 2011).
Choi, V. W. et al., "AAV Hybrid Serotypes: Improved Vectors for Gene Delivery," Curr Gene Ther., 5(3):299-310 (2005).
Chu, G. & Sharp, P. A., "SV40 DNA transfection of cells in suspension: analysis of the efficiency of transcription and translation of T-antigen," Gene, 13:197-202 (1981).
Clark, K. R. et al., "Cell Lines for the Production of Recombinant Adeno-Associated Virus," Human Gene Therapy, 6:1329-1341 (1995).
Cohn, R. et al., "A Contraction Stress Model of Hypertrophic Cardiomyopathy due to Sarcomere Mutations," Stem Cell Reports, 12:71-83 (2019).
Colson, B. A. et al., "Site-directed spectroscopy of cardiac myosin-binding protein C reveals effects of phosphorylation on protein structural dynamics," PNAS, 113(12):3233-3238 (2016).
Damdindorj, L. et al., "A Comparative Analysis of Constitutive Promoters Located in Adeno-Associated Viral Vectors," PLoS ONE, 9(8):e106472 (2014), 10 pages. doi:10.1371/journal.pone.0106472.
Dhandapany, P. S. et al., "A common MYBPC3 (cardiac myosin binding protein C) variant associated with cardiomyopathies in South Asia," Nature Genetics, 41(2):187-191 (2009).
Freeman, L. M. et al., "Feline Hypertrophic Cardiomyopathy: A Spontaneous Large Animal Model of Human HCM," Cariol. Res., 8(4):139-142 (2017).
Gallo, P. et al., "A lentiviral vector with a short troponin-I promoter for tracking cardiomyocyte differentiation of human embryonic stem cells," Gene Therapy, 15(3):161-70 (2008).
Giles, J. et al., "Recovery of left ventricular function following in vivo reexpression of cardiac myosin binding protein C," J. Gen. Physiol., 151(1):77-89 (2018).
Glazier, A. A. et al., "Allelic imbalance and haploinsufficiency in MYBPC3-linked hypertrophic cardiomyopathy," Pflügers Archiv—European Journal of Physiology, published online: Nov. 20, 2018, 13 pages. https://doi.org/10.1007/s00424-018-2226-9.
Glazier, A. A. et al., "HSC70 is a chaperone for wild-type and mutant cardiac myosin binding protein C," JCI Insight. 2018; 3(11):e99319, 16 pages. https://doi.org/10.1172/jci.insight.99319.
Graham, F. L. & Van Der Eb, A. J., "A New Technique for the Assay of Infectivity of Human Adenovirus 5 DNA," Virology, 52:456-467 (1973).
Granström, S. et al., "Genotypeephenotype correlation between the cardiac myosin binding protein C mutation A31P and hypertrophic cardiomyopathy in a cohort of Maine Coon cats: a longitudinal study," Journal of Veterinary Cardiology, 17:S268-S281 (2015).
Grunhaus, A. et al., "Association of Vaccinia Virus-Expressed Adenovirus E3-19K Glycoprotein with Class I MHC and Its Effects on Virulence in a Murine Pneumonia Model," Virology, 200:535-546 (1994).
Harris, S. P. et al., "Hypertrophic Cardiomyopathy in Cardiac Myosin Binding Protein-C Knockout Mice," Circ Res., 90:594-601 (2002).
Harris, S. P. et al., "In the Thick of It HCM-Causing Mutations in Myosin Binding Proteins of the Thick Filament," Circ Res., 108:751-764 (2011).
Helms, A. S. et al., "Effects of MYBPC3 loss of function mutations preceding hypertrophic cardiomyopathy," JCI Insight, Published Dec. 26, 2019, 42 pages. https://doi.org/10.1172/jci.insight.133782.
Helms, A. S. et al., "Effects of MYBPC3 loss-of-function mutations preceding hypertrophic cardiomyopathy," JCI Insight, 5(2):e133782 (2020), 20 pages. https://doi.org/10.1172/jci.insight.133782.
Helms, A. S. et al., "Sarcomere Mutation-Specific Expression Patterns in Human Hypertrophic Cardiomyopathy," Circ Cardiovasc Genet., 7:434-443 (2014).
Irion, S. et al., "Identification and targeting of the ROSA26 locus in human embryonic stem cells," Nature Biotechnology, 25(12):1477-1482 (2007).
Jaski, B. E. et al., "Calcium Upregulation by Percutaneous Administration of Gene Therapy in Cardiac Disease (CUPID Trial), a First-in-Human Phase 1/2 Clinical Trial," J Card Fail., 15(3):171-181 (2009). doi:10.1016/j.cardfail.2009.01.013.
Katz, M. G. et al., "Gene delivery technologies for cardiac applications," Gene Ther., 19(6):659-669 (2012). doi:10.1038/gt.2012.11.
Kittleson, M. D. et al., "The genetic basis of hypertrophic cardiomyopathy in cats and humans," Journal of Veterinary Cardiology, 17:S53-S73 (2015).
Konkalmatt, P. R. et al., "Cardiac-Selective Expression of EcSOD After Systemic Injection of AAV9 Protects the Heart Against Post-MI LV Remodeling," Circ Cardiovasc Imaging, 6(3):478-486 (2013). doi:10.1161/CIRCIMAGING.112.000320.
Kotterman, M. A. & Schaffer, D. V., "Engineering adeno-associated viruses for clinical gene therapy," Nature Reviews Genetics, 15:445-451 (2014).
Lekanne Deprez, R. H. et al., "Two cases of severe neonatal hypertrophic cardiomyopathy caused by compound heterozygous mutations in the MYBPC3 gene," J Med Genet, 43:829-832 (2006). doi: 10.1136/jmg.2005.040329.
Li, J. et al., "AAV9 gene transfer of cMyBPC N-terminal domains ameliorates cardiomyopathy in cMyBPC-deficient mice," JCI Insight, 5(17):e130182 (2020), 19 pages. https://doi.org/10.1172/jci.insight.130182.
Lian, X. et al., "Robust cardiomyocyte differentiation from human pluripotent stem cells via temporal modulation of canonical Wnt signaling," PNAS, Published online May 29, 2012, 109(27):E1848-E1857. https://doi.org/10.1073/pnas.1200250109.
Liu, Y. et al., "Generation of Targeted Adeno-Associated Virus (AAV) Vectors for Human Gene Therapy," Current Pharmaceutical Design, 21:3248-3256 (2015).
Liu, X. et al., "Screening Mutations of MYBPC3 in 114 Unrelated Patients with Hypertrophic Cardiomyopathy by Targeted Capture and Nextgeneration Sequencing," Scientific Reports, 5:11411 (2015), 8 pages. doi: 10.1038/srep11411.
Longerie, M. et al., "Myosin-Binding Protein C DNA Variants in Domestic Cats (A31P, A74T, R820W) and their Association with Hypertrophic Cardiomyopathy," J Vet Intern Med, 27:275-285 (2013).
Ma, H. et al., "Cell-specific expression of SERCA, the exogenous Ca2+ transport ATPase, in cardiac myocytes," Am J Physiol Cell Physiol, 286:C556-C564 (2004). First published Oct. 30, 2003. 10.1152/ajpcell.00328.2003.
Ma, Z. et al., "Contractile deficits in engineered cardiac microtissues as a result of MYBPC3 deficiency and mechanical overload," Nat Biomed Eng, 2:955-967 (2018). https://doi.org/10.1038/s41551-018-0280-4, and Supplementary Information, 16 pages.
Mamidi, R. et al., "Cardiac myosin binding protein-C: a novel sarcomeric target for gene therapy," Pflugers Arch—Eur J Physiol, 466:225-230 (2014).
Marian, A. J. & Braunwald, E., "Hypertrophic Cardiomyopathy Genetics, Pathogenesis, Clinical Manifestations, Diagnosis, and Therapy," Circ Res., 121:749-770 (2017). doi: 10.1161/CIRCRESAHA.117.311059.
Maron, B. J., "Clinical Course and Management of Hypertrophic Cardiomyopathy," N Engl J Med, 379:655-668 (2018).
Marston, S. et al., "Evidence From Human Myectomy Samples That MYBPC3 Mutations Cause Hypertrophic Cardiomyopathy Through Haploinsufficiency," Circ Res., 105:219-222 (2009).

(56) References Cited

OTHER PUBLICATIONS

Marziliano, N. et al., "A Case of Compound Mutations in the MYBPC3 Gene Associated with Biventricular Hypertrophy and Neonatal Death," Neonatology, 102:254-258 (2012).
McConnell, B. K. et al., "Dilated cardiomyopathy in homozygous myosin-binding protein-C mutant mice," J Clin Invest., 104(9):1235-1244 (1999).
McNamara, J. W. et al., "Ablation of cardiac myosin binding protein-C disrupts the super-relaxed state of myosin in murine cardiomyocytes," J Mol Cell Cardiol., 94:65-71 (2016). doi:10.1016/j.yjmcc.2016.03.009.
McNamara, J. W. et al., "MYBPC3 mutations are associated with a reduced super-relaxed state in patients with hypertrophic cardiomyopathy," PLoS One, 12(6):e0180064 (2017), 22 pages. https://doi.org/10.1371/journal.pone.0180064.
Mearini, G. et al., "Mybpc3 gene therapy for neonatal cardiomyopathy enables long-term disease prevention in mice," Nature Communications, 5:5155 (2014), doi: 10.1038/ncomms6515, 10 pages. http://www.nature.com/naturecommunications.
Merkulov, S. et al., "In Vivo Cardiac Myosin Binding Protein C Gene Transfer Rescues Myofilament Contractile Dysfunction in Cardiac Myosin Binding Protein C Null Mice," Circ Heart Fail., 5(5):635-644 (2012).
Meurs, K. M. et al., "A cardiac myosin binding protein C mutation in the Maine Coon cat with familial hypertrophic cardiomyopathy," Human Molecular Genetics, 14(23):0 3587-3593 (2005).
Meurs, K. M. et al., "A substitution mutation in the myosin binding protein C gene in ragdoll hypertrophic cardiomyopathy," Genomics, 90:261-264 (2007).
Miller, A. D., "Human gene therapy comes of age," Nature, 357:455-460 (1992).
Moolman, J. A. et al., "A Newly Created Splice Donor Site in Exon 25 of the MyBP-C Gene is Responsible for Inherited Hypertrophic Cardiomyopathy With Incomplete Disease Penetrance," Circulation, 101:1396-1402 (2000).
Moss, R. L., "Cardiacmyosin-binding protein C: A protein once at loose ends finds its regulatory groove," PNAS, 113(12):3133-3135 (2016).
Najafi, A. et al., "Sexual dimorphic response to exercise in hypertrophic cardiomyopathy-associated MYBPC3-targeted knock-in mice," Pflugers Arch—Eur J Physiol, 467:1303-1317 (2015).
Naso, M. F. et al., "Adeno-Associated Virus (AAV) as a Vector for Gene Therapy," BioDrugs, 31:317-334 (2017).
Needleman, S. B. & Wunsch, C. D., "A General Method Applicable to the Search for Similarities in the Amino Acid Sequence of Two Proteins," J. Mol. Biol., 48:443-453 (1970).
O'Leary, T. S. et al., "MYBPC3 truncation mutations enhance actomyosin contractile mechanics in human hypertrophic cardiomyopathy," J Mol Cell Cardiol., 127:165-173 (2019). doi:10.1016/j.yjmcc.2018.12.003.
Pearson, W. R. & Lipman, D. J., "Improved tools for biological sequence comparison," Proc. Natl. Acad. Sci., 85:2444-2448 (1988).
Pellegrino, A. et al., "Assessment of regional left ventricular systolic function by strain imaging echocardiography in phenotypically normal and abnormal Maine coon cats tested for the A31P mutation in the MYBPC3 gene," The Canadian Journal of Veterinary Research, 81:137-146 (2017).
Phillips, M. I. et al., "Vigilant Vector: Heart-Specific Promoter in an Adeno-Associated Virus Vector for Cardioprotection," Hypertension, 39[part2]:651-655 (2002).
Piras, B. A. et al., "Systemic injection of AAV9 carrying a periostin promoter targets gene expression to a myofibroblast-like lineage in mouse hearts after reperfused myocardial infarction," Gene Therapy, 23:469-478 (2016).
Pozsgai, E. R. et al., "Systemic AAV-Mediated b-Sarcoglycan Delivery Targeting Cardiac and Skeletal Muscle Ameliorates Histological and Functional Deficits in LGMD2E Mice," Molecular Therapy, 24(4):855-869 (2017).

Prasad, K.-M. et al., "Robust Cardiomyocyte-Specific Gene Expression Following Systemic Injection of AAV: In Vivo Gene Delivery Follows a Poisson Distribution," Gene Ther., 18(1):43-52 (2011). doi:10.1038/gt.2010.105.
Previs, M. J. et al., "Molecular Mechanics of Cardiac Myosin Binding Protein-C in Native Thick Filaments," Science, 337(6099):1215-1218 (2012). doi:10.1126/science.1223602.
Prondzynski, M. et al., "Evaluation of MYBPC3 trans-Splicing and Gene Replacement as Therapeutic Options in Human iPSC-Derived Cardiomyocytes," Molecular Therapy: Nucleic Acids, 7:475-486 (2017).
Prondzynski, M. et al., "Gene therapy strategies in the treatment of hypertrophic cardiomyopathy," Pflügers Archiv—European Journal of Physiology, 471(6244), 9 pages (2018). doi:10.1007/s00424-018-2173-5.
Rosas, P. C. et al., "Phosphorylation of Cardiac Myosin Binding Protein-C is a Critical Mediator of Diastolic Function," Circ Heart Fail., 8(3):582-594 (2015).
Rottbauer, W. et al., "Novel splice donor site mutation in the cardiac myosin-binding protein-C gene in familial hypertrophic cardiomyopathy. Characterization of cardiac transcript and protein," J Clin Invest., 100(2):475-482 (1997). https://doi.org/10.1172/JCI119555.
Sadayappan, S. & De Tombe, P. P., "Cardiac myosin binding protein-C: redefining its structure and function," Biophys Rev, 4:93-106 (2012).
Schlossarek, S. et al., "Defective proteolytic systems in Mybpc3-targeted mice with cardiac hypertrophy," Basic Res Cardiol, 107:235 (2012), 13 pages. doi: 10.1007/s00395-011-0235-3.
Stern, J. A. et al., "A Small Molecule Inhibitor of Sarcomere Contractility Acutely Relieves Left Ventricular Outflow Tract Obstruction in Feline Hypertrophic Cardiomyopathy," PLoS ONE, 11(12):e0168407, 13 pages. doi:10.1371/journal.pone.0168407.
Tidyman, W. E. et al., "In vivo regulation of the chicken cardiac troponin T gene promoter in zebrafish embryos," Developmental Dynamics, 227:484-496 (2003).
Toepfer, C. N. et al., "Hypertrophic cardiomyopathy mutations in MYBPC3 dysregulate myosin," Sci. Transl. Med., 11:eaat1199 (2019), 10 pages. doi: 10.1126/scitranslmed.aat1199.
Tohyama, S. et al., "Distinct Metabolic Flow Enables Large-Scale Purification of Mouse and Human Pluripotent Stem Cell-Derived Cardiomyocytes," Cell Stem Cell, 12(1):127-37 (2013).
Van Dijk, S. J. et al., "Cardiac Myosin-Binding Protein C Mutations and Hypertrophic Cardiomyopathy," Circulation, 119:1473-1483 (2009).
Van Dijk, S. J. et al., "Contractile Dysfunction Irrespective of the Mutant Protein in Human Hypertrophic Cardiomyopathy With Normal Systolic Function," Circ Heart Fail., 5:36-46 (2012).
Van Dijk, S. J. et al., "Point mutations in the tri-helix bundle of the M-domain of cardiac myosin binding protein-C influence systolic duration and delay cardiac relaxation," J Mol Cell Cardiol., 119:116-124 (2018). doi:10.1016/j.yjmcc.2018.05.001.
Van Dijk, S. J. et al., "The A31P missense mutation in cardiac myosin binding protein C alters protein structure but does not cause haploinsufficiency," Arch Biochem Biophys., 601:133-140 (2016). doi:10.1016/j.abb.2016.01.006.
Vera, T. R. et al., "The R820W mutation in the MYBPC3 gene, associated with hypertrophic cardiomyopathy in cats, causes hypertrophic cardiomyopathy and left ventricular non-compaction in humans," Int J Cardiol, 145(2):405-407 (2010). doi: 10.1016/j.ijcard.2010.04.032. Epub Jun. 14, 2010.
Vignier, N. et al., "Nonsense-Mediated mRNA Decay and Ubiquitin-Proteasome System Regulate Cardiac Myosin-Binding Protein C Mutant Levels in Cardiomyopathic Mice," Circ Res., 105:239-248 (2009).
Walsh, R. et al., "Reassessment of Mendelian gene pathogenicity using 7,855 cardiomyopathy cases and 60,706 reference samples," Genetics in Medicine, 19(2):192-203 (2017).
Werfel, S. et al., "Rapid and highly efficient inducible cardiac gene knockout in adult mice using AAV-mediated expression of Cre recombinase," Cardiovascular Research, 104(1):15-23 (2014).

(56) References Cited

OTHER PUBLICATIONS

Wess, G. et al., "Association of A31P and A74T Polymorphisms in the Myosin Binding Protein C3 Gene and Hypertrophic Cardiomyopathy in Maine Coon and Other Breed Cats," J Vet Intern Med, 24:527-532 (2010).

Wessels, M. W. et al., "Compound heterozygous or homozygous truncating MYBPC3 mutations cause lethal cardiomyopathy with features of noncompaction and septal defects," European Journal of Human Genetics, 23:922-928 (2015).

Wijnker, P. J. M. et al., "Comparison of the effects of a truncating and a missense MYBPC3 mutation on contractile parameters of engineered heart tissue," Journal of Molecular and Cellular Cardiology, 97:82-92 (2016).

Wu, Z. et al., "Effect of Genome Size on AAV Vector Packaging," Molecular Therapy, 18:80-86 (2010).

Xin, B. et al., "Homozygosity for a Novel Splice Site Mutation in the Cardiac Myosin-Binding Protein C Gene Causes Severe Neonatal Hypertrophic Cardiomyopathy," American Journal of Medical Genetics Part A, 143A:2662-2667 (2007).

Yang, Q. et al., "A mouse model of myosin binding protein C human familial hypertrophic cardiomyopathy," J Clin Invest., 102(7):1292-1300 (1998). https://doi.org/10.1172/JCI3880.

Zahka, K. et al., "Homozygous mutation of MYBPC3 associated with severe infantile hypertrophic cardiomyopathy at high frequency among the Amish," Heart, 94:1326-1330 (2008).

Zincarelli, C. et al., "Analysis of AAV Serotypes 1-9 Mediated Gene Expression and Tropism in Mice After Systemic Injection," Molecular Therapy, 16(6):1073-1080 (2008).

* cited by examiner

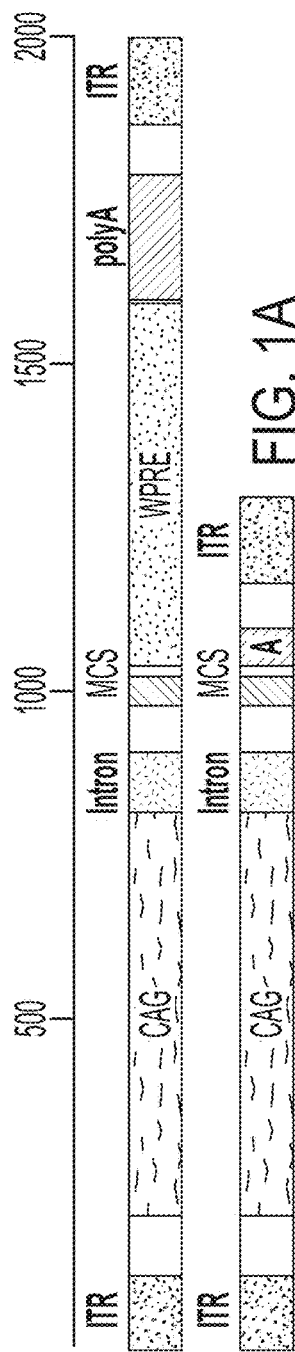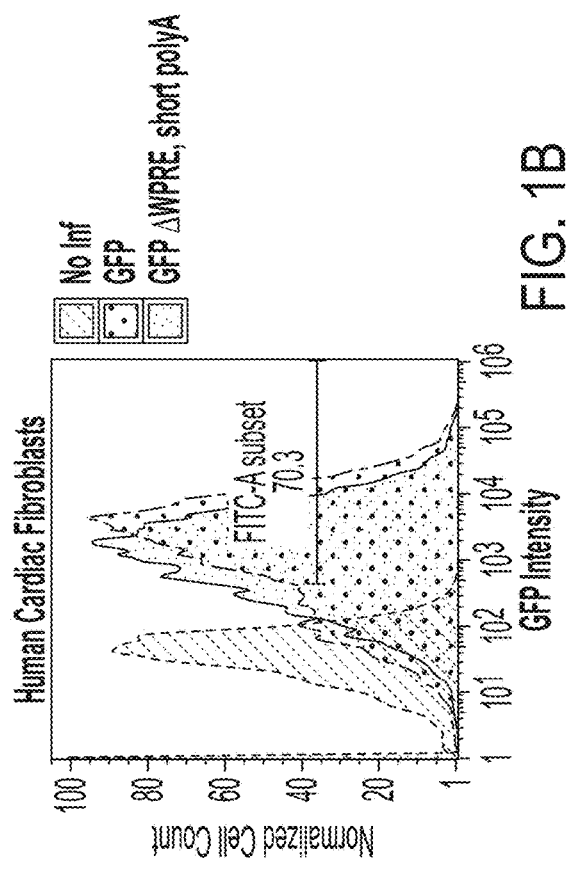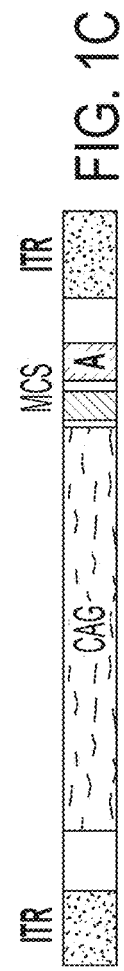
FIG. 1A
FIG. 1B
FIG. 1C

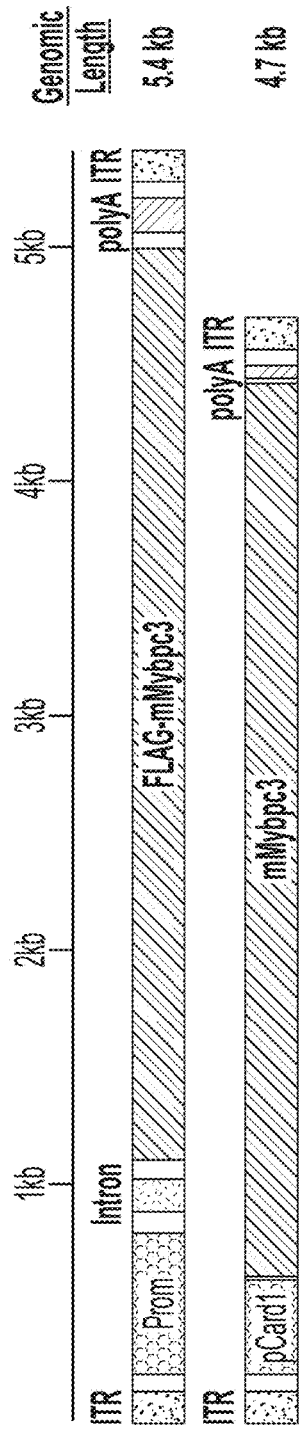
FIG. 10A
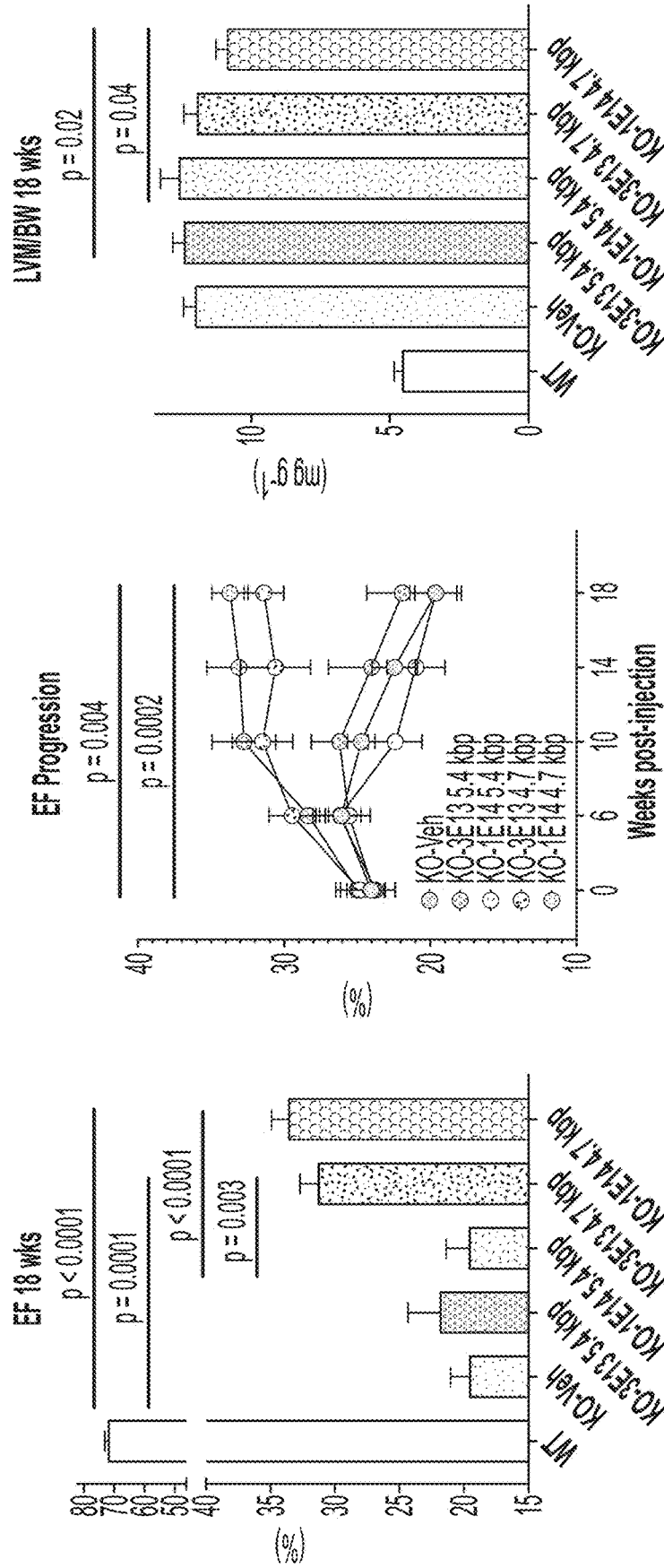
FIG. 10B
FIG. 10C
FIG. 10D

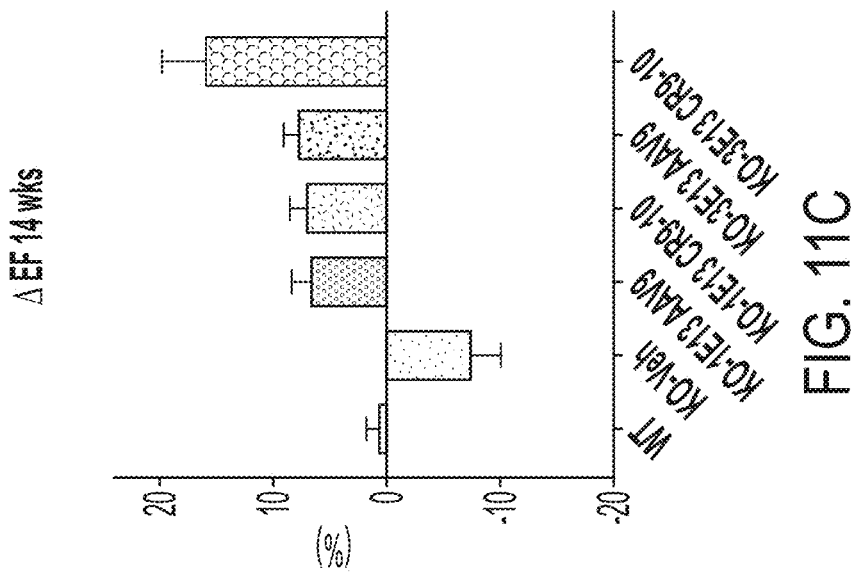
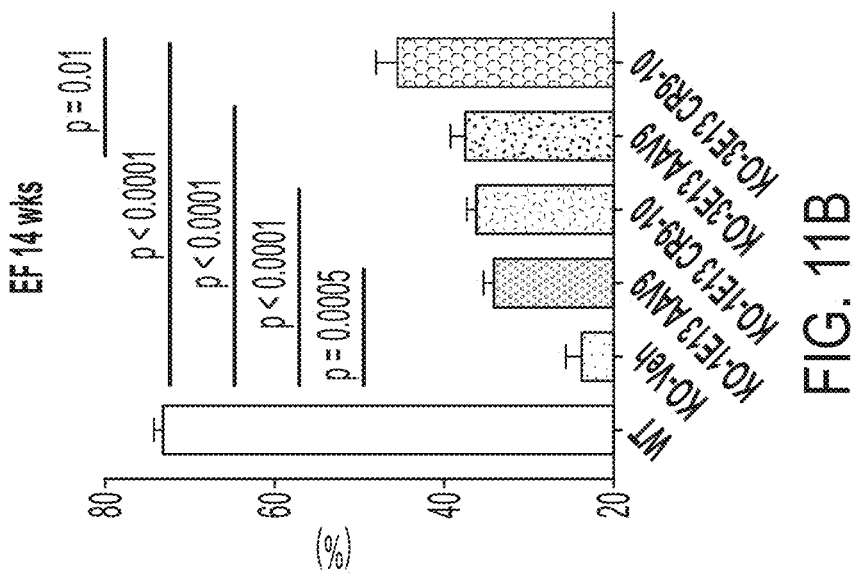
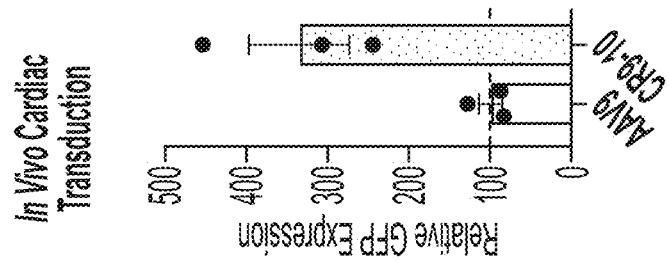
FIG. 11A
FIG. 11B
FIG. 11C

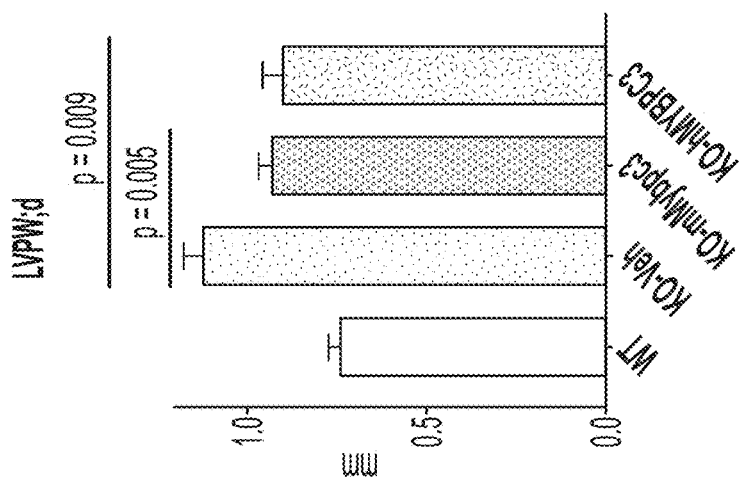
FIG. 13C
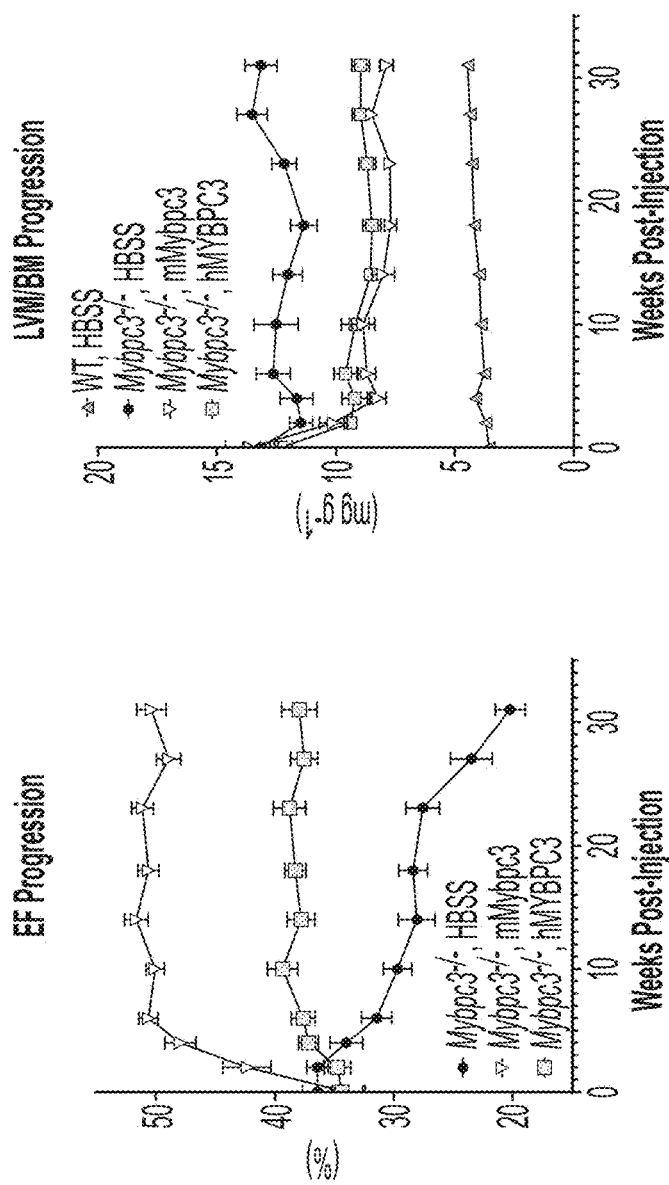
FIG. 13B
FIG. 13A

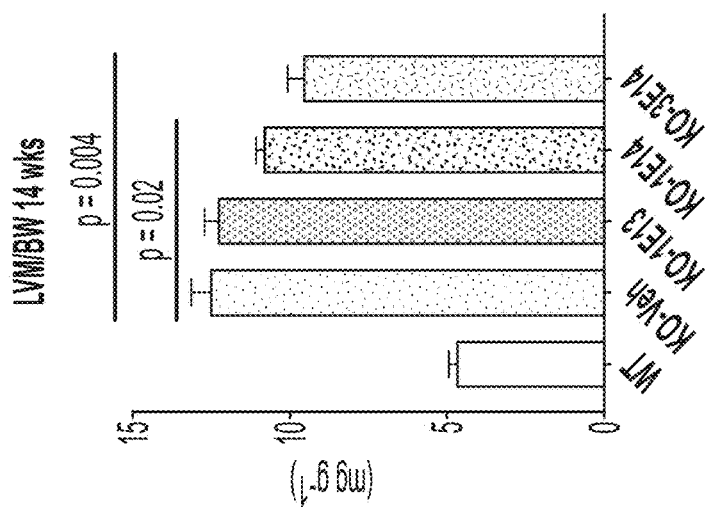
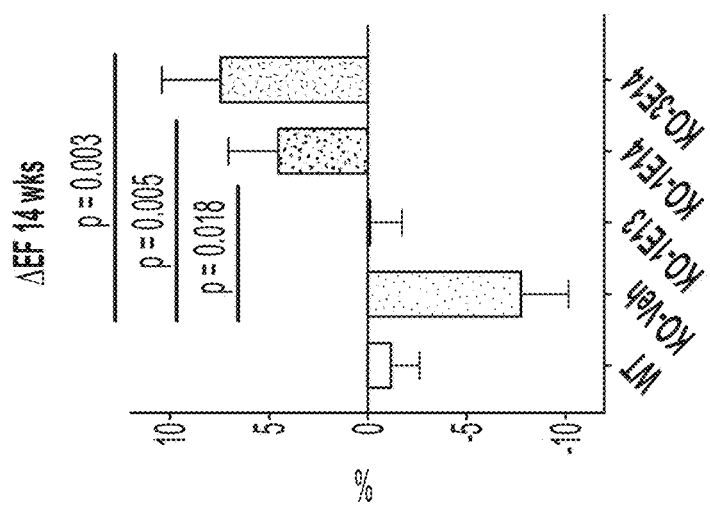
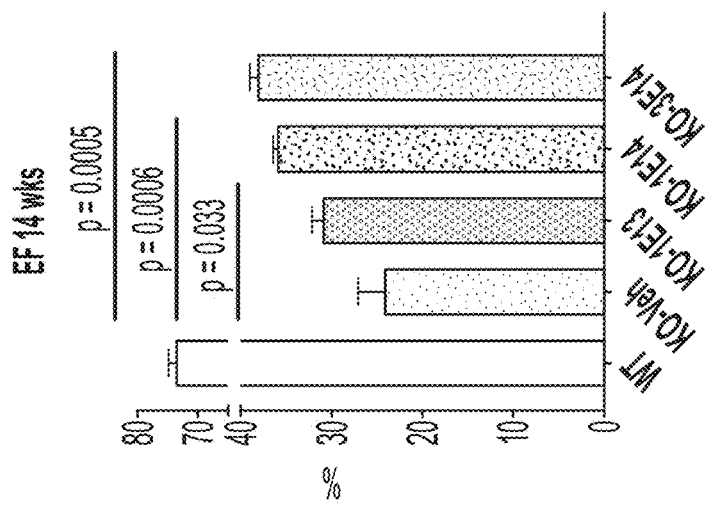
FIG. 14A
FIG. 14B
FIG. 14C

GENE THERAPY VECTORS FOR TREATING HEART DISEASE

CROSS REFERENCE TO RELATED APPLICATIONS

This application is a continuation of International PCT Application No. PCT/US2021/017699, filed Feb. 11, 2021, which claims the benefit of priority to U.S. Provisional Patent Application Ser. No. 63/047,633 filed on Jul. 2, 2020 and U.S. Provisional Patent Application Ser. No. 62/976,160 filed on Feb. 13, 2020, the contents of which are hereby incorporated by reference in their entireties.

TECHNICAL FIELD

The present disclosure relates to compositions and methods for the treatment or prevention of heart disease (e.g., cardiomyopathy) in a subject. In particular, the present disclosure relates to a vector comprising a cardiac-specific promoter operability linked to a therapeutic gene product for the treatment of heart disease (e.g., cardiomyopathy).

REFERENCE TO SEQUENCE LISTING

This application is being filed electronically via EFS-Web and includes an electronically submitted sequence listing in .txt format. The .txt file contains a sequence listing entitled "TENA_015_02US_SeqList_ST25.txt" created on Mar. 23, 2021 and having a size of 824 kilobytes. The sequence listing contained in this .txt file is part of the specification and is incorporated herein by reference in its entirety.

BACKGROUND

Gene therapy approaches for the treatment of heart disease often employ vectors configured to effectively transduce cardiac cells and to express a transgene in a cardiac-tissue specific manner. Adeno-associated virus (AAV) vectors, cardiac-specific promoters, or both in combination, may be used to deliver a polynucleotide encoding a gene product (e.g. a therapeutic protein) to heart tissue and thereby express the gene product in that tissue to treat the heart disease. Cardiac-specific promoters include desmin (Des), alpha-myosin heavy chain (α-WIC), myosin light chain 2 (MLC-2) and cardiac troponin C (TNNC1 or cTnC) promoters, as well as the 600 base pair cardiac troponin T (TNNT2) promoter. The delivery of polynucleotides encoding large proteins remains challenging, however, due in part to the packaging limit of viral vectors.

Given these challenges, there remains a need in the art for improved gene therapy vectors for heart disease.

SUMMARY

The present disclosure relates generally to compositions and methods for the treatment or prevention of heart disease (e.g. cardiomyopathy). In a first aspect, the present disclosure provides vectors comprising a promoter, optionally a cardiac-specific promoter, operably linked to a polynucleotide encoding a therapeutic gene product for the treatment of prevention of heart disease, e.g., cardiomyopathy. The vector may be an adeno-associated viral (AAV) vector.

In some aspects, the present disclosure provides a cardiac troponin T promoter, comprising a polynucleotide having between 300 bp and 500 bp. In some embodiments, the polynucleotide comprises a sequence that shares at least 80%, at least 90%, or at least 100% identity to any one of SEQ ID NOs: 1-85. In some embodiments, the polynucleotide comprises a sequence that shares at least 80%, at least 90%, or at least 100% identity to SEQ ID NO: 1. In some embodiments, the polynucleotide comprises a sequence that shares at least 80%, at least 90%, or at least 100% identity to SEQ ID NO: 3. In some embodiments, the polynucleotide shares at least 80%, 90%, 95%, 96%, 97%, 98%, 99%, or and 100% sequence identity with a genomic polynucleotide sequence upstream of and including the transcription start site of a troponin T gene. In some embodiments, the polynucleotide shares at least 80%, 90%, 95%, 96%, 97%, 98%, 99%, or and 100% sequence identity with a genomic polynucleotide sequence −450 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −350 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −250 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −450 bp to +50 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −350 bp to +50 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −250 bp to +50 bp relative to the transcription start site of a troponin T gene. In some embodiments, the troponin T gene is a human troponin T gene.

In some embodiments, the promoter is a muscle-specific promoter. In some embodiments, the promoter is a cardiac cell-specific promoter. In some embodiments, the promoter is a cardiomyocyte-specific promoter. In some embodiments, the promoter has the same cell-type specificity as a native troponin T promoter of about 600 bp. In some embodiments, the promoter described herein has the same cell-type specificity as a reference promoter comprising SEQ ID NO: 1. In some embodiments, the promoter expresses a gene product operatively linked thereto at least about 10%, at least about 20%, at least about 30% more than a native troponin T promoter. In some embodiments, the promoter described herein expresses a gene product operatively linked thereto at least about 10%, at least about 20%, at least about 30% more than a reference promoter comprising SEQ ID NO: 1.

In some aspects, the present disclosure provides a vector comprising any one of the promoters described herein operatively linked to a polynucleotide encoding a gene product. In some embodiments the vector is a viral vector. In some embodiments, the viral vector is an adeno-associated virus vector (AAV). In some embodiments, the viral vector has a packaging limit of at most about 5.5 kb.

In some embodiments, the gene product is selected from MYBPC3, KCNH2, TRPM4, DSG2, and ATP2A2 protein. In some embodiments, the gene product is selected from CACNA1C, DMD, DMPK, EPG5, EVC, EVC2, FBN1, NF1, SCN5A, SOS1, NPR1, ERBB4, VIP, and MYH7 proteins. In some embodiments, the gene product is a Cas9, optionally selected from SpCas9, St1Cas9, and SaCas9.

In some embodiments, the vector described herein comprises a polynucleotide encoding a second gene product. In some embodiments, the second gene product is a functional RNA, optionally a microRNA or a guide RNA.

In some aspects, the present disclosure provides an isolated cell comprising any one of the promoters described herein. In some embodiments, the isolated cell is an induced pluripotent stem cell or an isolated cardiomyocyte.

In some aspects, the present disclosure provides a pharmaceutical composition comprising any one of the vectors described herein.

In some aspects, the present disclosure provides a cell therapy composition comprising any one of the isolated cells described herein.

In some aspects, the present disclosure provides a recombinant adeno-associated virus (AAV) vector genome, comprising a MYBPC3 polynucleotide encoding a MYBPC3 protein, or a functional variant thereof, and a promoter, wherein the promoter is a polynucleotide having between 300 bp and 500 bp. In some embodiments, the polynucleotide comprises a sequence that shares at least 80%, at least 90%, or at least 100% identity to any one of SEQ ID NOs: 1-85. In some embodiments, the polynucleotide comprises a sequence that shares at least 80%, at least 90%, or at least 100% identity to any one of SEQ ID NO: 1. In some embodiments, the polynucleotide comprises a sequence that shares at least 80%, at least 90%, or at least 100% identity to any one of SEQ ID NO: 3. In some embodiments, the polynucleotide shares at least 80%, 90%, 95%, 96%, 97%, 98%, 99%, or and 100% sequence identity with a genomic polynucleotide sequence upstream of and including the transcription start site of a troponin T gene. In some embodiments, the polynucleotide shares at least 80%, 90%, 95%, 96%, 97%, 98%, 99%, or and 100% sequence identity with a genomic polynucleotide sequence −450 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −350 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −250 bp to +1 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −450 bp to +50 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −350 bp to +50 bp relative to the transcription start site of a troponin T gene. In some embodiments, the polynucleotide shares at least 80%, 90%, 95%, 96%, 97%, 98%, 99%, or and 100% sequence identity with a genomic polynucleotide sequence −250 bp to +50 bp relative to the transcription start site of a troponin T gene. In some embodiments, the troponin T gene is a human troponin T gene.

In some embodiments, the promoter is a muscle-specific promoter. In some embodiments, the promoter is a cardiac cell-specific promoter. In some embodiments, the promoter is a cardiomyocyte-specific promoter. In some embodiments, the promoter has the same cell-type specificity as a native troponin T promoter of about 600 bp. In some embodiments, the promoter has the same cell-type specificity as a reference promoter comprising SEQ ID NO: 1. In some embodiments, the promoter expresses a gene product operatively linked thereto at least about 10%, at least about 20%, at least about 30% more than a native troponin T promoter. In some embodiments, the promoter expresses a gene product operatively linked thereto at least about 10%, at least about 20%, at least about 30% more than a reference promoter comprising SEQ ID NO: 1.

In some embodiments, the recombinant adeno-associated virus (AAV) vector genome described herein comprises a MYBPC3 polynucleotide encoding a MYBPC3 protein. In some embodiments, the MYBPC3 polynucleotide comprises at least about 3.5 kB. In some embodiments, the MYBPC3 polynucleotide comprises about 3.8 kB. In some embodiments, the MYBPC3 is a full-length MYBPC3. In some embodiments, the MYBPC3 is a truncated MYBPC3.

In some embodiments, the rAAV vector genome described herein expresses MYBPC3. In some embodiments, the rAAV vector genome expresses MYBPC3 at about the same level as a reference AAV vector comprising a native troponin T promoter of about 600 bp. In some embodiments, the rAAV vector genome expresses MYBPC3 at a level at least about 10% greater than a reference AAV vector comprising a native troponin T promoter of about 600 bp. In some embodiments, the rAAV vector genome expresses MYBPC3 at a level at least about 20% greater than a reference AAV vector comprising a native troponin T promoter of about 600 bp.

In some aspects, the present disclosure provides a recombinant adeno-associated virus (AAV) vector genome, comprising an expression cassette comprising, in 5' to 3' order, a 5' segment comprising a promoter; a polynucleotide encoding a gene product; and a 3' segment comprising a polyA signal, the expression cassette optionally flanked by one or both of a 5' inverted terminal repeat (ITR) and a 3' ITR, wherein the polynucleotide encoding the gene product comprises between 3 kb and 11 kb, between 3 kb and 5 kb, between 3.5 kb and 4.5 kb, or between 3.7 kb and 4 kb; and wherein: a) the 5' segment and the 3' segment together comprise at most 0.8 kbp or at most 0.9 kbp; b) the 5' ITR, 5' segment, the 3' segment, and 3' ITR together comprise or at most 1.2 kbp, at most 1.3 kbp; and/or c) the vector genome comprises at most 4.7 kbp, at most 4.8 kbp, at most 4.9 kbp, or at most 5.0 kbp. In some embodiments, the 5' segment comprises at most 500 bp or at most 480 bp. In some embodiments, the 3' segment comprises at most 200 bp or at most 150 bp.

In some embodiments, the rAAV vector genome comprises a polynucleotide encoding a gene product comprising 3.7 kbp to 3.9 kbp, optionally 3.8 kbp. In some embodiments, the gene product is MYBPC3, or a functional variant thereof. In some embodiments, the gene product is MYBPC3. In some embodiments, the polynucleotide encoding MYBPC3 shares at least 90% identity to SEQ ID NO: 86. In some embodiments, the polynucleotide encoding MYBPC3 share at least 95% identify to SEQ ID NO: 86. In some embodiments the polynucleotide encoding MYBPC3 is SEQ ID NO: 86. In some embodiments, MYBPC3 shares at least 90% identity to the polypeptide sequence of SEQ ID NO: 103. In some embodiments, MYBPC3 shares at least 95% identity to the polypeptide sequence of SEQ ID NO: 103. In some embodiments, MYBPC3 shares 100% identity to the polypeptide sequence of SEQ ID NO: 103.

In some embodiments, the rAAV vector genome comprises a promoter, wherein the promoter is a polynucleotide having between 300 bp and 500 bp. In some embodiments the promoter comprises a sequence that shares at least 80% identity to SEQ ID NO:1-85. In some embodiments the promoter comprises a sequence that shares at least 90% identity to SEQ ID NO:1-85. In some embodiments the promoter comprises a sequence that shares at least 100% identity to SEQ ID NO:1-85.

In some embodiments, the rAAV vector genome comprises a polyA signal. In some embodiments, the polyA signal comprises, consists essentially of, or consists of a sequence that shares at least 90% identity to SEQ ID NO: 92. In some embodiments, the polyA signal comprises, consists essentially of, or consists of a sequence that shares at least 95% identity to SEQ ID NO: 92. In some embodiments, the polyA signal is SEQ ID NO: 92.

In some embodiments, the rAAV vector genome comprises a 5' segment. In some embodiments, the 5' segment shares at least 80% identity to SEQ ID NO: 93. In some embodiments, the 5' segment shares at least 90% identity to SEQ ID NO: 93. In some embodiments, the 5' segment shares at least 95% identity to SEQ ID NO: 93. In some embodiments, the 5' segment is SEQ ID NO: 93.

In some embodiments, the rAAV vector genome comprises a 3' segment. In some embodiments, the 3' segment shares at least 80% identity to SEQ ID NO: 94. In some embodiments, the 3' segment shares at least 90% identity to SEQ ID NO: 94. In some embodiments, the 3' segment shares at least 95% identity to SEQ ID NO: 94. In some embodiments, the 3' segment is SEQ ID NO: 94.

In some embodiments, the rAAV vector genome comprises an expression cassette. In some embodiments, the expression cassette shares at least 80% identity to SEQ ID NO: 95. In some embodiments, the expression cassette shares at least 90% identity to SEQ ID NO: 95. In some embodiments, the expression cassette shares at least 95% identity to SEQ ID NO: 95. In some embodiments, the expression cassette is SEQ ID NO: 95.

In some embodiments, the rAAV genome comprises an expression cassette that is flanked by one or both of a 5' inverted terminal repeat (ITR) and a 3' ITR. In some embodiments, the 5' ITR comprises a sequence that shares 95% identity to SEQ ID NO: 96. In some embodiments, the 3' ITR comprises a sequence that shares at least 95% identity to SEQ ID NO: 97.

In some aspects, the present disclosure provides a recombinant AAV (rAAV) virion. In some embodiments the rAAV virion comprises any one of the rAAV vector genomes described herein and an AAV capsid protein.

In some aspects, the present disclosure provides a method of expressing a MYBPC3 protein in a cell, comprising transducing the cell with an rAAV virion described herein or any one of the rAAV vector genomes described herein. In some embodiments, the cell is a MYBPC3$^{-/-}$ cell. In some embodiments, the cell comprises an inactivating mutation in one or both copies of the endogenous MYBPC3 gene.

In some aspects, the present disclosure provides a method of treating and/or preventing a cardiomyopathy in a subject in need thereof, comprising administering the rAAV virion described herein or any one of the rAAV vector genomes described herein to the subject, wherein optionally the subject suffers from or is at risk for cardiomyopathy.

In some aspects, the present disclosure provides a method of expressing a MYBPC3 protein in the heart of a subject in need thereof, comprising administering the rAAV virion described herein or any one of the rAAV vector genomes described herein to the subject, optionally a subject suffering from or at risk for cardiomyopathy, wherein optionally the subject suffers from or is at risk for cardiomyopathy.

In some embodiments, administration of the AAV vector causes specific expression of MYBPC3 in the heart of the subject. In some embodiments, administration of the AAV vector causes low or undetectable expression of MYBPC3 in the skeletal tissue, brain, and/or liver of the subject, wherein optionally the subject suffers from or is at risk for cardiomyopathy.

In some aspects, the present disclosure provides a method of treating a disease caused by a MYBPC3 mutation in a subject in need thereof, comprising administering the rAAV virion described or any one of the rAAV vector genomes described herein to the subject, wherein optionally the subject suffers from or is at risk for cardiomyopathy.

In some aspects, the present disclosure provides a method of increasing MYBPC3 activity and/or increasing cardiac function in the heart of a subject in need thereof, comprising administering the rAAV virion described herein or any one of the rAAV vector genomes described herein to the subject, wherein optionally the subject suffers from or is at risk for cardiomyopathy.

In some embodiments, the methods described herein treats the cardiomyopathy. In some embodiments, the methods described herein prevents the cardiomyopathy. In some embodiments, the cardiomyopathy is hypertrophic cardiomyopathy.

In some embodiments, the methods described herein comprise intravenous administration of the rAAV virion described herein or any one of the rAAV vector genomes described herein to the subject. In some embodiments, the methods described herein comprise intracardiac administration of the rAAV virion described herein or any one of the rAAV vector genomes described herein to the subject. In some embodiments, the methods described herein comprise direct injection of the rAAV virion described herein or any one of the rAAV vector genomes described herein to the subject. In some embodiments, the methods described herein comprise administering a dose of about $10^{11}$ to about $10^{14}$ rAAV virions per kg or viral genomes per kg.

In some embodiments, the subject is a mammal. In some embodiments, the subject is a human. In some embodiments, the subject is an adult.

In some embodiments, the pharmaceutical compositions described herein are for use as a medicament in therapeutic or prophylactic treatment of heart disease, e.g. cardiomyopathies.

BRIEF DESCRIPTION OF THE DRAWINGS

FIG. 1A shows maps of insert sequences for AAV vector genomes adapted for large cargoes, showing deletion or truncation of two cis-regulatory elements.

FIG. 1B shows flow cytometry analysis, two days post-infection, of human cardiac fibroblasts (n=2), MOI 160,000 with AAV-packaged constructs.

FIG. 1C shows a map of an insert sequence for an AAV vector genome adapted for large cargoes, showing deletion or truncation of two cis-regulatory elements, deletion of the intron, and partial deletion of the sequence 3' to the 5' ITR.

FIG. 10A is an illustration of an AAV9 vector encoding Mybpc3 in the context of the 5.4 kbp or 4.7 kbp expression cassettes.

FIG. 10B is a bar graph showing ejection fraction in homozygous Mybpc3$^{-/-}$ mice 18 weeks after they were injected retro-orbitally at three months of age with 3E13 vg·kg$^{-1}$ or 1E14 vg·kg$^{-1}$ of AAV9 vector encoding Mybpc3 in the context of the 5.4 kbp or 4.7 kbp cassettes, or injected with vehicle control, HBSS.

FIG. 10C is a plot showing ejection fraction progression in homozygous Mybpc3$^{-/-}$ mice after they were injected retro-orbitally at three months of age with 3E13 vg·kg$^{-1}$ or 1E14 vg·kg$^{-1}$ of AAV9 vector encoding Mybpc3 in the context of the 5.4 kbp or 4.7 kbp cassettes, or injected with vehicle control, HBSS.

FIG. 10D is a bar graph showing left ventricular mass normalized to body weight (LVM/BM) in homozygous Mybpc3$^{-/-}$ mice 18 weeks after they were injected retro-orbitally at three months of age with 3E13 vg·kg$^{-1}$ or 1E14 vg·kg$^{-1}$ of AAV9 vector encoding Mybpc3 in the context of the 5.4 kbp or 4.7 kbp cassettes, or injected with vehicle control, HBSS.

FIG. 11A is a bar graph showing GFP expression in cardiac tissue following systemic delivery of an AAV9 capsid variant, CR9-10, with a GFP-encoding cassette or AAV9 with a GFP-encoding cassette in adult mice (p <0.05, One-way ANOVA; Dunnett's multiple comparison test).

FIG. 11B is a bar graph showing ejection fraction in Mybpc3$^{-/-}$ mice injected retro-orbitally at two weeks of age with 1E13 vg·kg-1 and 3E13 vg·kg-1 of AAV9 vector encoding Mybpc3, CR9-10 vector encoding Mybpc3, or vehicle control HBSS.

FIG. 11C is a bar graph showing ejection fraction compared to pre-dose baseline (AEF) in Mybpc3$^{-/-}$ mice injected retro-orbitally at two weeks of age with 1E13 vg·kg-1 and 3E13 vg·kg-1 of AAV9 vector encoding an expression cassette Mybpc3 gene, CR9-10 vector encoding an expression cassette Mybpc3 gene, or vehicle control HBSS.

Figure 12B:
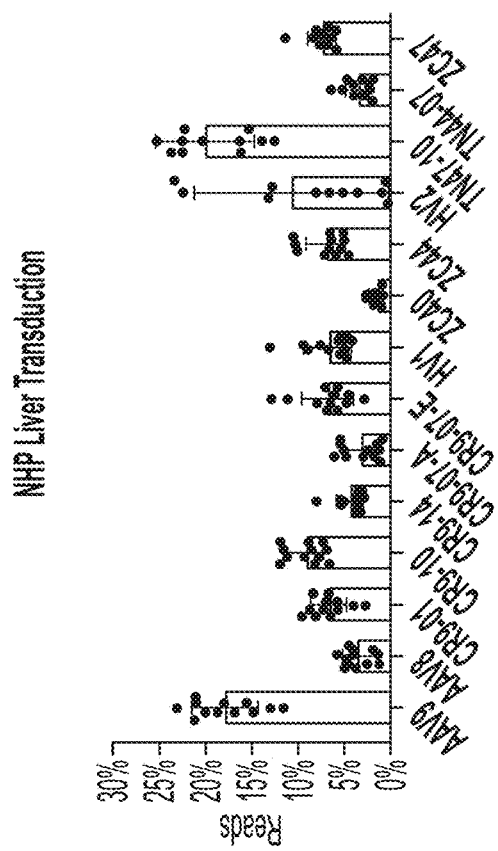
Figure 12A:
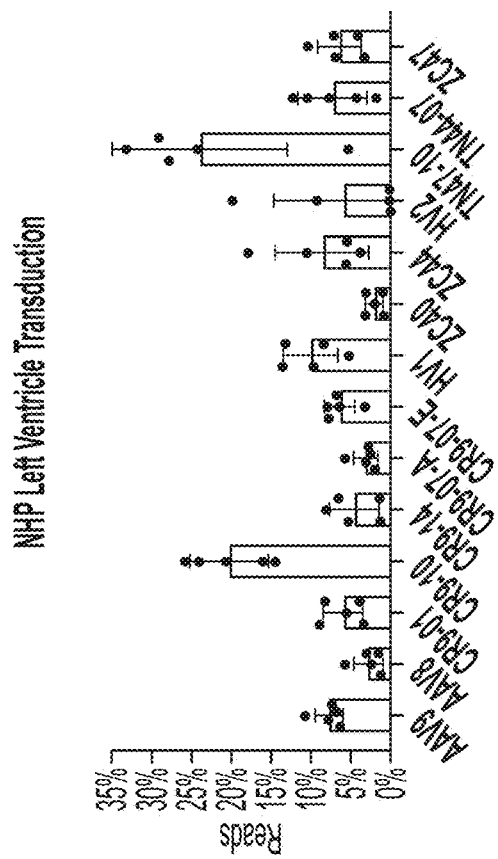

FIG. 12A is a bar graph showing GFP expression in the left ventricle of non-human primates one month after intravenous delivery of 1E13 vg·kg-1 dose of AAV vector encoding GFP packaged in one of fourteen different capsid proteins.

FIG. 12B is a bar graph showing GFP expression in the liver of non-human primates one month after intravenous delivery of 1E13 vg·kg-1 dose of AAV vector encoding GFP packaged in one of fourteen different capsid proteins.

Figure 12C:
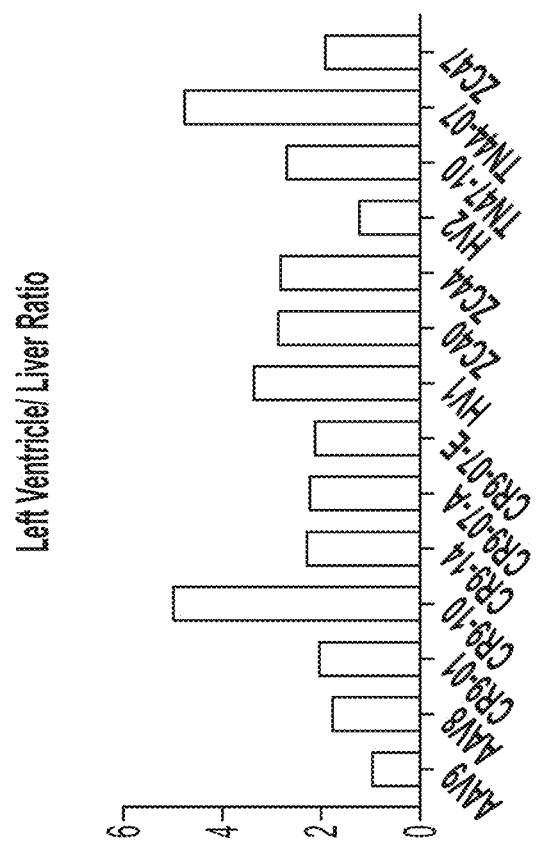

FIG. 12C is a bar graph showing the ratio of GFP expression in the left ventricle:liver of non-human primates one month after intravenous delivery of 1E13 vg·kg$^{-1}$ dose of AAV vector encoding GFP packaged in one of fourteen different capsid proteins.

FIG. 13A is a plot showing ejection fraction progression in homozygous Mybpc3$^{-/-}$ mice that were injected retro-orbitally at two weeks of age with AAV9 encoding the mouse Mybpc3 gene (mMybpc3) (at 1E14 vg·kg), AAV9 encoding the human MYBPC3 gene (hMYBPC3) (at 1E14 vg·kg$^{-1}$), or vehicle, HBSS.

FIG. 13B is a plot showing left ventricular mass normalized to body weight (LVM/BW) progression in homozygous Mybpc3$^{-/-}$ mice that were injected retro-orbitally at two weeks of age with AAV9 encoding the mouse Mybpc3 gene (mMybpc3) (at 1E14 vg·kg$^{-1}$), AAV9 encoding the human MYBPC3 gene (hMYBPC3) (at 1E14 vg·kg$^{-1}$), or vehicle, HBSS.

FIG. 13C is a bar graph left ventricular posterior wall thickness during diastole (LVPW;d) in homozygous Mybpc3$^{-/-}$ mice that were injected retro-orbitally at two weeks of age with AAV9 encoding the mouse Mybpc3 gene (mMybpc3) (at 1E14 vg·kg$^{-1}$), AAV9 encoding the human MYBPC3 gene (hMYBPC3) (at 1E14 vg·kg$^{-1}$), or vehicle, HBSS.

FIG. 14A is a bar graph showing ejection fraction in homozygous Mybpc3$^{-/-}$ mice that were injected retro-orbitally at two weeks of age with 1E13 vg·kg$^{-1}$, 1E14 vg·kg$^{-1}$, and 3E14 vg·kg$^{-1}$ of test vector encoding the human MYBPC3 gene or vehicle, HBSS.

FIG. 14B is a bar graph showing ejection fraction compared to pre-dose baseline (AEF) in homozygous Mybpc3$^{-/-}$ mice that were injected retro-orbitally at two weeks of age with 1E13 vg·kg$^{-1}$, 1E14 vg·kg$^{-1}$, and 3E14 vg·kg$^{-1}$ of test vector encoding the human MYBPC3 gene or vehicle, HBSS.

FIG. 14C is a bar graph showing left ventricular mass normalized to body weight (LVM/BW) in homozygous Mybpc3$^{-/-}$ mice that were injected retro-orbitally at two weeks of age with 1E13 vg·kg$^{-1}$, 1E14 vg·kg$^{-1}$, and 3E14 vg·kg$^{-1}$ of test vector encoding the human MYBPC3 gene or vehicle, HBSS.

DETAILED DESCRIPTION

The present disclosure provides compositions and methods for gene therapy in cardiac cells and/or with large genes. The disclosed polynucleotides and vectors may be used in treatment or prevention of disease (e.g. heart disease, such as cardiomyopathy). The present disclosure provides cardiac-specific promoters, expression cassettes, recombinant adeno-associated virus (rAAV) viral genomes, rAAV virions, pharmaceutical compositions, and methods of use. The expression cassettes and rAAV viral genomes may comprise a cardiac-specific promoter operably linked to a polynucleotide encoding a gene product. The gene product may be a therapeutic gene product, such therapeutic gene product used to treat and/or prevent heart disease, e.g. cardiomyopathy. The disclosure further provides rAAV viral genomes and expression cassettes engineered to deliver and express a large gene product. In some embodiments, the vector genome comprises a polynucleotide encoding a MYBPC3 polypeptide, or a functional variant thereof and a promoter. In some embodiments, the promoter is a cardiac troponin T promoter (i.e., a TNNT2 promoter). In some embodiments, the rAAV vector genome comprises an expression cassette comprising a polynucleotide encoding a gene product, e.g. MYBPC3 and a promoter, e.g. TNNT2 promoter, flanked by one or more inverted terminal repeat polynucleotide sequences. In some embodiments, the rAAV virion comprises a polynucleotide comprising an rAAV vector genome as described herein and an AAV capsid protein. The present disclosure also provides pharmaceutical compositions comprising the vector genomes, rAAV vector genomes, and rAAV virions described herein. Also provided are methods of treating and/or preventing a cardiomyopathy in a subject comprising administering the rAAV virions or vector genomes described herein.

Other embodiments, features, and advantages of the invention will be apparent from and encompassed by the following detailed description and claims.

I. Definitions

As used in this specification and the appended claims, the singular forms "a," "an" and "the" include plural references unless the content clearly dictates otherwise.

As used in this specification, the term "and/or" is used in this disclosure to mean either "and" or "or" unless indicated otherwise.

Throughout this specification, unless the context requires otherwise, the words "comprise", or variations such as "comprises" or "comprising", will be understood to imply the inclusion of a stated element or integer or group of elements or integers but not the exclusion of any other element or integer or group of elements or integers.

As used in this application, the terms "about" and "approximately" are used as equivalents. Any numerals used in this application with or without about/approximately are meant to cover any normal fluctuations appreciated by one of ordinary skill in the relevant art. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

The terms "polynucleotide" and "nucleic acid," used interchangeably herein, refer to a polymeric form of nucleotides of more than about 100 nucleotides, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as "oligomers" or "oligos" and may be isolated from genes, or chemically synthesized by methods known in the art. The terms "polynucleotide" and "nucleic acid" should be understood to include, as applicable to the embodiments being described, single-stranded (such as sense or antisense) and double-stranded polynucleotides.

The term "promoter" as used herein refers a polynucleotide sequence that has one or more recognition site(s) to which an RNA polymerase binds, such that in a host or target cell, an RNA polymerase may initiate and transcribe a polynucleotide sequence "downstream" of the promoter into an RNA. Similarly stated, a "promoter" is operably linked or operatively linked to a polynucleotide sequence if in a host or target cell in which the promoter is active, an RNA polymerase initiates transcription of the polynucleotide at a transcription state site. Promoters operative in mammalian cells generally comprise an AT-rich region located approximately 25 to 30 bases upstream from the site where transcription is initiated and/or another sequence found 70 to 80 bases upstream from the start of transcription, a CNCAAT region where N may be any nucleotide.

The terms "upstream" and "upstream end" refer to a portion of a polynucleotide that is, with reference to a transcription start site (TSS), 5' to the TSS on the sense strand (or coding strand) of the polynucleotide; and 3' to the TSS on the antisense strand of the polynucleotide. The terms "downstream" and "downstream end" refer to a portion of a polynucleotide that is, with reference to a TSS, 3' to TSS on the sense strand (or coding strand) of the polynucleotide; and 5' to the TSS on the antisense strand of the polynucleotide. Thus, a deletion from the upstream end of a promoter is a deletion of one or more base pairs in the non-transcribed region of the polynucleotide, 5' to the TSS on the sense strand (or equivalently, 3' to the TSS on the antisense strand). A deletion from the downstream end of a promoter is a deletion of one or more base pairs in the transcribed region of the polynucleotide, 3' to the TSS on the sense strand (or equivalently, 5' to the TSS on the antisense strand).

As used herein, the term "transgene" refers to a nucleic acid sequence encoding a protein or RNA (e.g., a therapeutic protein), which is partly or entirely heterologous, i.e., foreign, to the transgenic animal or cell into which it is introduced, or, is homologous to an endogenous gene of the transgenic animal or cell into which it is introduced, but which is designed to be inserted, or is inserted, into the animal's genome in such a way as to alter the genome of the cell into which it is inserted (e.g., it is inserted at a location which differs from that of the natural gene or its insertion results in a knockout). A transgene can include one or more transcriptional regulatory sequences and any other nucleic acid, such as introns, that may be necessary for optimal expression of a selected nucleic acid.

The term "sequence identity" refers to the percentage of bases or amino acids between two polynucleotide or polypeptide sequences that are the same, and in the same relative position. As such one polynucleotide or polypeptide sequence has a certain percentage of sequence identity compared to another polynucleotide or polypeptide sequence. For sequence comparison, typically one sequence acts as a reference sequence, to which test sequences are compared. The term "reference sequence" refers to a molecule to which a test sequence is compared.

Methods of sequence alignment for comparison and determination of percent sequence identity is well known in the art. Optimal alignment of sequences for comparison can be conducted, e.g., by the homology alignment algorithm of Needleman and Wunsch, J. Mol. Biol. 48:443 (1970), by the search for similarity method of Pearson and Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), by manual alignment and visual inspection (see, e.g., Brent et al., Current Protocols in Molecular Biology (2003)), by use of algorithms know in the art including the BLAST and BLAST 2.0 algorithms, which are described in Altschul et al., Nuc. Acids Res. 25:3389-3402 (1977); and Altschul et al., J. Mol. Biol. 215:403-410 (1990), respectively. Software for performing BLAST analyses is publicly available through the National Center for Biotechnology Information.

In some embodiments, the determination of the percentage of sequence identity may take place after a local alignment. Such alignments are well known in the art, for instance the service EMBOSS Matcher identifies local similarities between two sequences using an algorithm based on the LALIGN application, version 2.0u4. In an example, the identity between two nucleic acid sequences may be calculated using the service Matcher (EMBOSS) set to the default parameters, e.g. matrix (DNAfull), gap open (16), gap extend (4), alternative matches (1).

An "expression cassette" or "expression construct" refers to a DNA polynucleotide sequence operably linked to a promoter. "Operably linked" or "operatively linked" refers to a juxtaposition wherein the components so described are in a relationship permitting them to function in their intended manner. For instance, a promoter is operably linked to a polynucleotide sequence if the promoter affects the transcription or expression of the polynucleotide sequence.

As used herein, the term "delivery", which is used interchangeably with "transduction," refers to the process by which exogenous nucleic acid molecules are transferred into a cell such that they are located inside the cell. Delivery of nucleic acids is a distinct process from expression of nucleic acids.

The term "modified" refers to a substance or compound (e.g., a cell, a polynucleotide sequence, and/or a polypeptide sequence) that has been altered or changed as compared to the corresponding unmodified substance or compound.

The term "sample" refers to a biological composition (e.g., a cell or a portion of a tissue) that is subjected to analysis and/or genetic modification. In some embodiments, a sample is a "primary sample" in that it is obtained directly from a subject; in some embodiments, a "sample" is the result of processing of a primary sample, for example to remove certain components and/or to isolate or purify certain components of interest.

The term "gene" or "recombinant gene" refers to a nucleic acid comprising an open reading frame encoding a polypeptide, including both exon and (optionally) intron sequences.

The term "transfection" refers to the uptake of foreign DNA by a cell. A cell has been "transfected" when exogenous DNA has been introduced inside the cell membrane. A number of transfection techniques are generally known in the art. See, e.g., Graham et al., Virology 52:456 (1973); Sambrook et al., Molecular Cloning: A Laboratory Manual (1989); Davis et al., Basic Methods in Molecular Biology (1986); Chu et al., Gene 13:197 (1981). Such techniques can be used to introduce one or more exogenous DNA moieties, such as a nucleotide integration vector and other nucleic acid molecules, into suitable host cells. The term captures chemical and electrical transfection procedures.

The term "expression" refers to the process by which a nucleic acid is translated into peptides or is transcribed into RNA, which, for example, can be translated into peptides, polypeptides or proteins. If the nucleic acid is derived from genomic DNA, expression may, if an appropriate eukaryotic host cell or organism is selected, include splicing of the mRNA. For heterologous nucleic acid to be expressed in a host cell, it must initially be delivered into the cell and then, once in the cell, ultimately reside in the nucleus.

The term "gene therapy" involves the transfer of heterologous DNA to cells of a mammal, particularly a human, with a disorder or conditions for which therapy or diagnosis is sought. The DNA is introduced into the selected target cells in a manner such that the heterologous DNA is expressed and a therapeutic product encoded thereby is produced. Alternatively, the heterologous DNA may in some manner mediate expression of DNA that encodes the therapeutic product; it may encode a product, such as a peptide or RNA that in some manner mediates, directly or indirectly, expression of a therapeutic product. Gene therapy may also be used to deliver nucleic acid encoding a gene product to replace a defective gene or supplement a gene product produced by the mammal or the cell in which it is introduced. The introduced nucleic acid may encode a therapeutic gene product that is not normally produced in the mammalian host or that is not produced in therapeutically effective amounts or at a therapeutically useful time. The heterologous DNA encoding the therapeutic product may be modified prior to introduction into the cells of the afflicted host in order to enhance or otherwise alter the product or expression thereof.

As used herein, a "heterologous" polynucleotide or nucleic acid refers to a polynucleotide or portion of a polynucleotide derived from a source other than the host organism or, for a viral vector, the native, non-recombinant virus. Examples of heterologous DNA include, but are not limited to, DNA that encodes traceable marker proteins, such as a protein that confers drug resistance, DNA that encodes therapeutically effective substances, such as anti-cancer agents, enzymes and hormones, and DNA that encodes other types of proteins, such as antibodies.

The term "wild type" refers to the naturally-occurring polynucleotide sequence encoding a protein, or a portion thereof, or protein sequence, or portion thereof, respectively, as it normally exists in vivo in a normal or healthy subject.

The term "variant" refers to a protein or nucleic acid having one or more genetic changes (e.g. insertions, deletions, substitutions, or the like) that returns all or substantially all of the functions of the reference protein or nucleic acid. For example, a variant of a therapeutic protein retains the same or substantially the same activity and/or provides the same or substantially the same therapeutic benefit to a subject in need thereof. A variant of a promoter sequence retains the ability to initiate transcription at the same or substantially the same level as the reference promoter, and retains the same or substantially the same cell type specificity. In particular embodiments, polynucleotides variants have at least or about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a reference sequence. In particular embodiments, protein variants have at least or about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a reference sequence.

The term "subject" includes animals, such as e.g. mammals. In some embodiments, the mammal is a primate. In some embodiments, the mammal is a human. In some embodiments, subjects are livestock such as cattle, sheep, goats, cows, swine, and the like; or domesticated animals such as dogs and cats. In some embodiments (e.g., particularly in research contexts) subjects are rodents (e.g., mice, rats, hamsters), rabbits, primates, or swine such as inbred pigs and the like. The terms "subject" and "patient" are used interchangeably herein.

The term "administering" to a subject is a procedure by which one or more delivery agents, together or separately, are introduced into or applied onto a subject such that target cells which are present in the subject are eventually contacted with the agent.

"Treating" as used herein refers to delivering an agent or composition to a subject to affect a physiologic outcome.

As used herein, the term "gene product" refers to the a protein or nucleic acid produced by the transcription of a polynucleotide and, in the case of a protein gene product, the subsequent translation of transcript into a protein. A "therapeutic gene product" refers to a gene product that provides a therapeutic physiological effect or benefit to a subject in need when expressed in a therapeutic amount in a subject.

As used herein, the term "therapeutic protein" refers to a protein or polypeptide that provides a therapeutic physiological effect or benefit to a subject in need when expressed or administered in a therapeutic amount in a subject. In some embodiments, treatment with a therapeutic protein or a vector that expresses a therapeutic protein provides a therapeutic physiological effect or benefit to a subject with heart disease (e.g., a subject with cardiomyopathy). Illustrative therapeutic proteins for the treatment of heart disease are provided in Table 2.

As used herein, the term "cardiomyopathy" refers to the deterioration of the function of the myocardium (i.e., the actual heart muscle) for any reason. Subjects with cardiomyopathy are often at risk of arrhythmia or sudden cardiac death or both.

As used herein, the term "hypertrophic cardiomyopathy" refers to a disease of the heart and myocardium in which a portion of the myocardium is hypertrophied.

As used herein, the term "familial hypertrophic cardiomyopathy" refers to a genetic disorder characterized by increased growth (i.e., hypertrophy) in thickness of the wall of the left ventricle.

As used herein, the term "effective amount" refers to the minimum amount of an agent or composition required to result in a particular physiological effect. The effective amount of a particular agent may be represented in a variety of ways based on the nature of the agent, such as mass/volume, # of cells/volume, particles/volume, (mass of the agent)/(mass of the subject), # of cells/(mass of subject), or particles/(mass of subject). The effective amount of a particular agent may also be expressed as the half-maximal effective concentration ($EC_{50}$), which refers to the concentration of an agent that results in a magnitude of a particular physiological response that is half-way between a reference level and a maximum response level.

II. Polynucleotides

In some embodiments, the present disclosure provides polynucleotide sequences for the treatment and/or prevention of heart disease (e.g., cardiomyopathy). In some embodiments, the polynucleotide sequences comprise a cardiac-specific promoter operatively linked to a polynucleotide encoding one or more therapeutic gene products for the treatment and/or prevention of cardiomyopathy.

Polynucleotides refer to a polymeric form of nucleotides of at least 5, at least 10, at least 15, at least 20, at least 25, at least 30, at least 40, at least 50, at least 100, at least 200, at least 300, at least 400, at least 500, at least 1000, at least 5000, at least 10000, or at least 15000 or more nucleotides in length, either ribonucleotides or deoxyribonucleotides or a modified form of either type of nucleotide, as well as all intermediate lengths. "Intermediate lengths," in this context, means any length between the quoted values, such as 6, 7, 8, 9, etc., 101, 102, 103, etc.; 151, 152, 153, etc.; 201, 202, 203, etc.

As a result of the degeneracy of the genetic code, there are many nucleotide sequences that encode a polypeptide, or fragment of variant thereof, as described herein. Some of these polynucleotides bear minimal homology to the nucleotide sequence of any native gene. Nonetheless, polynucleotides that vary due to differences in codon usage are specifically contemplated in particular embodiments, for example polynucleotides that are optimized for human and/or primate codon selection. Further, alleles of the genes comprising the polynucleotide sequences provided herein may also be used. Alleles are endogenous genes that are altered as a result of one or more mutations, such as deletions, additions and/or substitutions of nucleotides.

The polynucleotides contemplated herein, regardless of the length of the coding sequence itself, may be combined with other DNA sequences, such as promoters and/or enhancers, untranslated regions (UTRs), signal sequences, Kozak sequences, polyadenylation signals, additional restriction enzyme sites, multiple cloning sites, internal ribosomal entry sites (IRES), recombinase recognition sites (e.g., LoxP, FRT, and Att sites), termination codons, transcriptional termination signals, and polynucleotides encoding self-cleaving polypeptides, epitope tags, as disclosed elsewhere herein or as known in the art.

Polynucleotides can be prepared, manipulated and/or expressed using any of a variety of well-established techniques known and available in the art.

In some embodiments, the polynucleotide sequence is a promoter. In some embodiments, the polynucleotide sequence is a promoter operatively linked to a polynucleotide encoding a therapeutic gene product for the treatment or prevention of heart disease (e.g., cardiomyopathy).

In some embodiments, the vector comprises a cardiac-specific promoter which is operably linked to a polynucleotide encoding a therapeutic gene product (e.g., encoding a therapeutic protein, e.g., MYBPC3 protein). As used herein, a "cardiac-specific promoter" refers to a promoter whose activity in cardiac cells is at least 2-fold higher than in any other non-cardiac cell type. Preferably, a cardiac-specific promoter suitable for being used in the vector of the invention has an activity in cardiac cells which is at least 5-fold, at least 10-fold, at least 15-fold, at least 20-fold, at least 25-fold, or at least 50-fold higher compared to its activity in a non-cardiac cell type.

In some embodiments, the vector comprises a cardiomyocyte-specific promoter which is operably linked to a polynucleotide encoding a therapeutic gene product (e.g., MYBPC3 protein). A "cardiomyocyte-specific promoter", as used herein, specifies a promoter whose activity in cardiomyocytes is at least 2-fold higher than in any other non-cardiac cell type or cardiac cell which is not a cardiomyocyte. Preferably, a cardiomyocyte-specific promoter suitable for being used in the vector of the present disclosure has an activity in cardiomyocytes which is at least 5-fold, at least 10-fold, at least 15-fold, at least 20-fold, at least 25-fold, or at least 50-fold higher compared to its activity in a non-cardiac cell type or a cardiac cell type which is not a cardiomyocyte.

In some embodiments, the cardiac-specific or cardiomyocyte-specific promoter is a human promoter. Examples of cardiac-specific or cardiomyocyte-specific promoter include, but are not limited to, the alpha myosin heavy chain promoter, the myosin light chain 2v promoter, the alpha myosin heavy chain promoter, the alpha-cardiac actin promoter, the alpha-tropomyosin promoter, the cardiac troponin C promoter, the cardiac troponin I promoter, the cardiac myosin-binding protein C promoter, and the sarco/endoplasmic reticulum $Ca^{2+}$ ATPase (SERCA) promoter (e.g. isoform 2 of SERCA2).

In some embodiments, the cardiac-specific promoter is the cardiac TNNT2 promoter. In some embodiments, the cardiac TNNT2 promoter is modified, e.g., by the deletion, insertion, or substitution of polynucleotides. Illustrative polynucleotide sequences of the cardiac TNNT2 promoter are shown in Table 1 below. The transcription start site (TSS) of the TNNT2 promoters are bolded and underlined.

TABLE 1

Illustrative TNNT2 promoters

| Name | DNA Sequence | SEQ ID NO. |
|---|---|---|
| TNNT2p-600 | GTCATGGAGAAGACCCACCTTGCAGATGTCCTCACTGGGGCTGGCAGAGCCG GCAACCTGCCTAAGGCTGCTCAGTCCATTAGGAGCCAGTAGCCTGGAAGATG TCTTTACCCCCAGCATCAGTTCAAGTGGAGCAGCACATAACTCTTGCCCTCT GCCTTCCAAGATTCTGGTGCTGAGACTTATGGAGTGTCTTGGAGGTTGCCTT CTGCCCCCCAACCCTGCTCCCAGCTGGCCCTCCCAGGCCTGGGTTGCTGGCC TCTGCTTTATCAGGATTCTCAAGAGGGACAGCTGGTTTATGTTGCATGACTG TTCCCTGCATATCTGCTCTGGTTTTAAATAGCTTATCTGAGCAGCTGGAGGA CCACATGGCTTATATGGCGTGGGGTACATGTTCCTGTAGCCTTGTCCCTGG CACCTGCCAAAATAGCAGCCAACACCCCCCACCCCCACCGCCATCCCCCTGC CCCACCCGTCCCCTGTCGCACATTCCTCCCTCCGCAGGGCTGGCTCACCAGG CCCCAGCCCACATGCCTGCTTAAAGCCCTCTCCATCCTCTGCCTCACCCAGT CCCCGCTGAGACTGAGCAGACGCCTCCA | 1 |
| TNNT2p-500 | GATGTCTTTACCCCCAGCATCAGTTCAAGTGGAGCAGCACATAACTCTTGCC CTCTGCCTTCCAAGATTCTGGTGCTGAGACTTATGGAGTGTCTTGGAGGTTG CCTTCTGCCCCCCAACCCTGCTCCCAGCTGGCCCTCCCAGGCCTGGGTTGCT | 2 |

TABLE 1-continued

Illustrative TNNT2 promoters

| Name | DNA Sequence | SEQ ID NO. |
|------|--------------|------------|
| | GGCCTCTGCTTTATCAGGATTCTCAAGAGGGACAGCTGGTTTATGTTGCATG<br>ACTGTTCCCTGCATATCTGCTCTGGTTTTAAATAGCTTATCTGAGCAGCTGG<br>AGGACCACATGGGCTTATATGGCGTGGGGTACATGTTCCTGTAGCCTTGTCC<br>CTGGCACCTGCCAAAATAGCAGCCAACACCCCCACCCCCACCGCCATCCCC<br>CTGCCCCACCCGTCCCCTGTCGCACATTCCTCCCTCCGCAGGGCTGGCTCAC<br>CAGGCCCCAGCCCACATGCCTGCTTAAAGCCCTCTCCATCCTCTGCCTCACC<br>CAGTCCCCGCTGAGACTGAGCAGACGCCTCCA | |
| TNNT2p-400 | GTTGCCTTCTGCCCCCCAACCCTGCTCCCAGCTGGCCCTCCCAGGCCTGGGT<br>TGCTGGCCTCTGCTTTATCAGGATTCTCAAGAGGGACAGCTGGTTTATGTTG<br>CATGACTGTTCCCTGCATATCTGCTCTGGTTTTAAATAGCTTATCTGAGCAG<br>CTGGAGGACCACATGGGCTTATATGGCGTGGGGTACATGTTCCTGTAGCCTT<br>GTCCCTGGCACCTGCCAAAATAGCAGCCAACACCCCCACCCCCACCGCCAT<br>CCCCCTGCCCCACCCGTCCCCTGTCGCACATTCCTCCCTCCGCAGGGCTGGC<br>TCACCAGGCCCCAGCCCACATGCCTGCTTAAAGCCCTCTCCATCCTCTGCCT<br>CACCCAGTCCCCGCTGAGACTGAGCAGACGCCTCCA | 3 |
| TNNT2p-300 | GTTGCATGACTGTTCCCTGCATATCTGCTCTGGTTTTAAATAGCTTATCTGA<br>GCAGCTGGAGGACCACATGGGCTTATATGGCGTGGGGTACATGTTCCTGTAG<br>CCTTGTCCCTGGCACCTGCCAAAATAGCAGCCAACACCCCCACCCCCACCG<br>CCATCCCCCTGCCCCACCCGTCCCCTGTCGCACATTCCTCCCTCCGCAGGGC<br>TGGCTCACCAGGCCCCAGCCCACATGCCTGCTTAAAGCCCTCTCCATCCTCT<br>GCCTCACCCAGTCCCCGCTGAGACTGAGCAGACGCCTCCA | 4 |

In some embodiments, the cardiac TNNT2 promoter is modified to comprise a polynucleotide sequence of between about 200 and 500 base pairs, between about 250 and 500 base pairs, between about 300 to 500 base pairs, between about 350 to 500 base pairs, between about 400 to 500 base pairs, between about 450 to 500 base pairs, between about 200 and 450 base pairs, between about 200 and 400 base pairs, between about 200 and 350 base pairs, between about 200 and 300 base pairs, and between about 200 and 250 base pairs in length. In some embodiments, the modified cardiac TNNT2 promoter comprises a polynucleotide sequence of between about 350 base pairs to about 450 base pairs, between about 375 base pairs to about 425 base pairs, between about 375 base pairs to about 400 base pairs, between about 375 base pairs to about 425 base pairs, between about 400 base pairs to about 425 base pairs, or between about 400 base pairs to about 450 base pairs. In some embodiments, the cardiac TNNT2 promoter comprises a polynucleotide sequence of about 400 base pairs.

In a particular embodiment, the modified cardiac troponin T promoter comprises between 300 bp and 500 bp of SEQ ID NO: 1. For instance, the modified cardiac troponin T promoter may comprise SEQ ID NO: 3. In some examples, the 300 bp-500 bp sequence may be linked to further polynucleotide sequences but may not be linked to additional sequences derived from SEQ ID NO: 1. For example, in an embodiment, the modified cardiac troponin T promoter may include no more than 500 bp of SEQ ID NO: 1 but may include additional unrelated polynucleotide sequences. In another example, the modified cardiac troponin T promoter may include SEQ ID NO: 3, no additional sequences derived from SEQ ID NO: 1, but may include additional unrelated polynucleotide sequences.

In some embodiments, the cardiac TNNT2 promoter is modified by the deletion of polynucleotides. A modification may include one, two, three or more internal deletions. Each deletion may be a deletion of 1 base pair, 2 base pairs, 3 base pairs, 4 base pairs, 5 base pairs, 10 base pairs, 15 base pairs, 20 base pairs, 25 base pairs, 30 base pairs, 40 base pairs, 50 base pairs, 60 base pairs, 70 base pairs, 80 base pairs, 90 base pairs, 100 base pairs, 125 base pairs, 150 base pairs, 175 base pairs, 200 base pairs, 225 base pairs, 250 base pairs, 275 base pairs, or 300 base pairs with respect to a reference cardiac TNNT2 promoter (SEQ ID NO: 1) having about 600 base pairs.

In some embodiments, the TNNT2 promoter is modified by the deletion of polynucleotides from the upstream end of the promoter with respect to a reference cardiac TNNT2 promoter (SEQ ID NO: 1) having about 600 base pairs. A modification may include the deletion of 1 base pair, 2 base pairs, 3 base pairs, 4 base pairs, 5 base pairs, 10 base pairs, 15 base pairs, 20 base pairs, 25 base pairs, 30 base pairs, 40 base pairs, 50 base pairs, 60 base pairs, 70 base pairs, 80 base pairs, 90 base pairs, 100 base pairs, 125 base pairs, 150 base pairs, 175 base pairs, 200 base pairs, 225 base pairs, 250 base pairs, 275 base pairs, or 300 base pairs from the upstream end of the promoter with respect to a reference cardiac TNNT2 promoter (SEQ ID NO: 1) having about 600 base pairs. In some embodiments, the modification is a 200 base pair deletion from the upstream end of the promoter with respect to a reference cardiac TNNT2 promoter (SEQ ID NO: 1) having about 600 base pairs.

In some embodiments, the cardiac TNNT2 promoter is modified by the deletion of polynucleotides from the downstream end of the promoter with respect to a reference cardiac TNNT2 promoter (SEQ ID NO: 1) having about 600 base pairs. A modification may include the deletion of 1 base pair, 2 base pairs, 3 base pairs, 4 base pairs, 5 base pairs, 10 base pairs, 15 base pairs, 20 base pairs, 25 base pairs, 30 base pairs, 40 base pairs, 50 base pairs, 60 base pairs, 70 base pairs, 80 base pairs, 90 base pairs, 100 base pairs, 125 base pairs, 150 base pairs, 175 base pairs, 200 base pairs, 225 base pairs, 250 base pairs, 275 base pairs, or 300 base pairs from the downstream end of the promoter with respect to a reference cardiac TNNT2 promoter (SEQ ID NO: 1) having about 600 base pairs.

In some embodiments, the cardiac TNNT2 promoter is modified by an internal deletion of polynucleotides. A modification may include the internal deletion of 1 base pair, 2 base pairs, 3 base pairs, 4 base pairs, 5 base pairs, 10 base pairs, 15 base pairs, 20 base pairs, 30 base pairs, 40 base pairs, 50 base pairs, 60 base pairs, 70 base pairs, 80 base pairs, 90 base pairs, 100 base pairs, 125 base pairs, 150 base pairs, 175 base pairs, 200 base pairs, 225 base pairs, 250 base pairs, 275 base pairs, or 300 base pairs with respect to a reference cardiac TNNT2 promoter (SEQ ID NO: 1).

In some embodiments, the cardiac TNNT2 promoter is modified by the insertion of polynucleotides. A modification may include the insertion of 1 base pair, 2 base pairs, 3 base pairs, 4 base pairs, 5 base pairs, 10 base pairs, 15 base pairs, 20 base pairs, 25 base pairs, 30 base pairs, 35 base pairs, 40 base pairs, 45 base pairs, 50 base pairs, 55 base pairs, 60 base pairs, 65 base pairs, 70 base pairs, 75 base pairs, 80, base pairs, 85 base pairs, 90 base pairs, 100 base pairs, 125 base pairs, 150 base pairs, 175 base pairs, 200 base pairs, 225 base pairs, 250 base pairs, 275 base pairs, or 300 base pairs with respect to a reference cardiac TNNT2 promoter (SEQ ID NO: 1).

In some embodiments, the cardiac TNNT2 promoter is modified by the substitution of polynucleotides. A modification may include the substitution of 1 base pair, 2 base pairs, 3 base pairs, 4 base pairs, 5 base pairs, 6 base pairs, 7 base pairs, 8 base pairs, 9 base pairs, or 10 base pairs with respect to a reference cardiac TNNT2 promoter (SEQ ID NO: 1).

In some embodiments, the polynucleotide sequence of the TNNT2 promoter shares at least 80%, 90%, 95%, 96%, 97%, 98%, 99%, or 100% sequence identity with the polynucleotide sequence −450 base pairs to +1 base pairs relative to the transcription start site of the human TNNT2 gene. In some embodiments, the polynucleotide sequence of the TNNT2 promoter shares at least 80%, 90%, 95%, 96%, 97%, 98%, 99%, or and 100% sequence identity with the polynucleotide sequence −350 base pairs to +1 base pairs relative to the transcription start site of the human TNNT2 gene. In some embodiments, the polynucleotide sequence of the TNNT2 promoter shares at least 80%, 90%, 95%, 96%, 97%, 98%, 99%, or and 100% sequence identity with the polynucleotide sequence −250 base pairs to +1 base pairs relative to the transcription start site of the human TNNT2 gene.

In some embodiments, the polynucleotide sequence of the cardiac TNNT2 promoter shares at least 80%, 90%, 95%, 96%, 97%, 98%, 99%, or and 100% sequence identity with the polynucleotide sequence −450 base pairs to +50 base pairs relative to the transcription start site of the TNNT2 gene. In some embodiments, the polynucleotide sequence of the cardiac TNNT2 promoter shares at least 80%, 90%, 95%, 96%, 97%, 98%, 99%, or and 100% sequence identity with the polynucleotide sequence −350 base pairs to +50 base pairs relative to the transcription start site of the TNNT2 gene. In some embodiments, the polynucleotide sequence of the cardiac TNNT2 promoter shares at least 80%, 90%, 95%, 96%, 97%, 98%, 99%, or and 100% sequence identity with the polynucleotide sequence −250 base pairs to +5 base pairs relative to the transcription start site of the TNNT2 gene.

In some embodiments, the cardiac TNNT2 promoter comprises a polynucleotide comprising a sequence that shares at least 80%, 90%, 95%, 96%, 97%, 98%, 99%, or and 100% identity to any one of SEQ ID NOs: 1-85. In some embodiments, the polynucleotide comprises a sequence that shares at least 80% identity to any one of SEQ ID NOS: 1-85. In some embodiments, the polynucleotide comprises a sequence that shares at least 90% identity to any one of SEQ ID NOS: 1-85. In some embodiments, the polynucleotide comprises a sequence that shares at least 100% identity to any one of SEQ ID NOS: 1-85. In some embodiments, the polynucleotide comprises a sequence that shares at least 80% identity to SEQ ID NO: 1. In some embodiments, the polynucleotide comprises a sequence that shares at least 90% identity to SEQ ID NO: 1. In some embodiments, the polynucleotide comprises a sequence that shares at least 100% identity to SEQ ID NO: 1. In some embodiments, the polynucleotide comprises a sequence that shares at least 80% identity to SEQ ID NO: 3. In some embodiments, the polynucleotide comprises a sequence that shares at least 90% identity to SEQ ID NO: 3. In some embodiments, the polynucleotide comprises a sequence that shares at least 100% identity to SEQ ID NO: 3.

B. Illustrative Gene Products (Proteins)

The promoters of the disclosure may be operatively linked to a polynucleotide comprising a sequence encoding a gene product (e.g., protein or nucleic acid). In some embodiments, the gene product is a therapeutic protein. The therapeutic protein may be any of the native human proteins listed in Table 2, or functional homologs or variants thereof. The promoters of the disclosure are particularly suited for use with large genes that may otherwise be expressed at low levels or not be expressed when delivered by a viral vector. An advantage of some embodiments disclosed herein lies in the ability to express a therapeutic protein (particularly a large therapeutic protein) in a viral vector having limited packaging capacity, e.g., an AAV vector. A "large" protein is any protein whose size impacts expression in a selected vector. Generally, "large" therapeutic proteins comprise at least about 1000 or more amino acids—that is, the protein is encoded by a polynucleotide sequence of about 3 kbps or greater. Illustrative proteins, including large proteins, are provided in Table 2 below.

TABLE 2

Illustrative Proteins

| Gene Name | Gene Symbol | NCBI Gene ID | UniProt ID |
|---|---|---|---|
| Myosin-binding protein C | MYBPC3 | 4607 | Q14896 |
| Potassium voltage-gated channel subfamily H member 2 | KCNH2 | 3757 | Q12809 |
| Transient receptor potential cation channel subfamily M member 4 | TRPM4 | 54795 | Q8TD43 |
| Desmoglein-2 | DSG2 | 1829 | Q14126 |
| ATPase sarcoplasmic/endoplasmic reticulum calcium transporting 2 | ATP2A2 | 488 | P16615 |
| Calcium voltage-gated channel subunit alpha 1C | CACNA1C | 775 | Q13936 |
| Dystrophin | DMD | 1756 | P11532 |
| DM1 protein kinase | DMPK | 1760 | Q09013 |
| Ectopic P granules protein 5 homolog | EPG5 | 57724 | Q9HCE0 |
| EvC ciliary complex subunit 1 | EVC | 2121 | P57679 |
| Limbin | EVC2 | 132884 | Q86UK5 |
| Fibrillin-1 | FBN1 | 2200 | P35555 |
| Neurofibromin | NF1 | 4763 | P21359 |
| Sodium channel protein type 5 subunit alpha | SCN5A | 6331 | Q14524 |
| Son of sevenless homolog 1 | SOS1 | 6654 | Q07889 |
| Natriuretic peptide receptor 1 | NPR1 | 4881 | P16066 |
| Receptor tyrosine-protein kinase erbB-4 | ERBB4 | 2066 | Q15303 |
| Vasoactive intestinal peptide | VIP | 7432 | P01282 |
| Beta-myosin heavy chain | MYH7 | 4625 | P12883 |

Various therapeutic polynucleotides, or therapeutic proteins encoded by polynucleotides, having lengths of 3 kilobases or greater are expressed more effectively when operatively linked to a modified TNNT2 promoter of the disclosure compared to a TNNT2 promoter of about 600 base pairs. The promoters of the disclosure are useful in expression of, at least, the following: a) large genes in which loss-of-function mutations result in cardiomyopathy (gene replacement therapy); b) large genes whose expression in cardiomyocytes is cardioprotective; c) combinations of genes whose co-expression in cardiomyocytes is beneficial; and d) tools for cardiomyocyte-specific genome editing. A "large" gene is any gene whose size impacts expression in a selected vector. Generally, "large" therapeutic genes encode proteins that comprise at least about 1000 or more amino acids—that is, the gene comprises a polynucleotide sequence of about 3 kbps or greater. In further embodiments, the vectors and promoters of the disclosure are used in treatment of the diseases or disorders list in Table 3, where the polynucleotide encodes the therapeutic protein indicated in the table.

TABLE 3

Illustrative Therapeutic Gene Products for Heart Disease

| Condition | Therapeutic Gene Product | Gene Size (kb) |
|---|---|---|
| Timothy syndrome | CACNA1C | 6.663 |
| Becker muscular dystrophy | DMD | 11.055 |
| Duchenne muscular dystrophy | DMD | 11.055 |
| Myotonic dystrophy type 1 | DMPK | 4.653 |
| Vici syndrome | EPG5 | 7.737 |
| Ellis-Van Creveld syndrome | EVC | 2.976 |
| Ellis-Van Creveld syndrome | EVC2 | 3.924 |
| Marfan syndrome | FBN1 | 8.613 |
| Long QT Syndrome | KCNH2 | 3.477 |
| Neurofibromatosis Noonan syndrome | NF1 | 3.517 |
| Brugada Syndrome | SCN5A | 6.048 |
| Long QT Syndrome | SCN5A | 6.048 |
| Paroxysmal ventricular fibrillation 1 | SCN5A | 6.048 |
| Progressive familial heart block type 1A | SCN5A | 6.048 |
| Noonan syndrome | SOS1 | 3.999 |
| Progressive familial heart block type 1B | TRPM4 | 3.642 |
| Acute decompensated heart failure (ADHF) | NPR1 | 3.183 |
| Congestive Heart Failure (CHF) | ERBB4 | 3.924 |
| Congestive Heart Failure (CHF) | VIP analog* | 3.729 |
| Hypertrophic cardiomyopathy | MYBPC3 | 3.822 |
| Left Ventricular Noncompaction Cardiomyopathy | MYBPC3 | 3.822 |
| Hypertrophic cardiomyopathy | MYH7 | 5.805 |
| Left Ventricular Noncompaction Cardiomyopathy | MYH7 | 5.805 |

*VIP fused to an ELP biopolymer (e.g., PB1046) to increase stability in vivo

MYBPC3 is a gene expressed in cardiac cells. Various mutations in MYBPC3 are known to cause hypertrophic cardiomyopathy. Almost half of all mutations causative for hypertrophic cardiomyopathy result in truncations, via nonsense, frameshift or splice-site mutations (Marian and Braunwald, Circ. Res. 121:749-770 (2017); Walsh et al., Genet. Med. 19:192-203 (2017). mRNAs containing premature stop codons are subjected to surveillance and degradation by nonsense-mediated decay machinery. This is consistent with decreased levels of mutant RNAs in analysis of cardiac tissue from hypertrophic cardiomyopathy patients who have received myectomies (Marston et al., Circ. Res. 105:219-222 (2009); van Dijk et al., Circulation 119:1473-1483 (2009); Helms et al., Circ. Cardiovasc. Genet. 7:434-443 (2014). Further, any resultant truncated polypeptides appear sensitive to the ubiquitin-proteasome degradation system. In patient myectomy samples, no truncated protein was observed for nine distinct mutations (Rottbauer et al., J. Clin. Invest. 100:475-482 (1997); Moolman et al., Circulation 101:1396-1402 (2000); Marston et al., Circ. Res. 105: 219-222 (2009); van Dijk et al., Circ. Heart Fail 5:36-46 (2012)). Even though it appears that the wild-type MYBPC3 allele in heterozygous patients is slightly upregulated, the total amount of MYBPC3 protein incorporated into sarcomeres falls significantly below normal at ~65% (Marston et al., Circ. Res. 105:219-222 (2009); van Dijk et al., Circ. Heart Fail 5:36-46 (2012); McNamara et al., PLoS One 12:e0180064 (2017)). Thus, the sarcomeric pathophysiology of hypertrophic cardiomyopathy patients with MYBPC3 truncating mutations appears to be due to haploinsufficiency.

In some embodiments, the disclosure provides a vector comprising a polynucleotide sequence that encodes the MYBPC3 protein, operatively linked to a modified cardiac TNNT2 promoter. Similarly stated, in some embodiments, the polynucleotide sequence operatively linked to the cardiac-specific promoter (e.g., a modified cardiac TNNT2 promoter) is MYBPC3, or a mutant, variant, or fragment thereof. In humans, the MYBPC3 gene encodes the MYBPC3 protein (also known as MyBP-C), which regulates the cardiac sarcomere, the basic unit of muscle contraction. The cardiac muscle sarcomere consists of thick and thin filaments, and MYBPC3 attaches to the thick filaments to prevent premature degradation. Illustrative MYBPC3 polynucleotide sequences are shown in Table 4A below. In some embodiments, the polynucleotide encoding MYBPC3 shares at least 85%, 90%, 95%, 99%, or 100% identity to any one of SEQ ID NOs: 86-89. Illustrative MYBPC3 protein sequences are shown in Table 4B. In some embodiments, the vector genome encodes an MYBPC3 protein that shares at least 85%, 90%, 95%, 99%, or 100% identity to any one of SEQ ID NOs: 103-106.

TABLE 4A

Illustrative MYBPC3 Polynucleotide Sequences

| Name | DNA Sequence | SEQ ID NO. |
|---|---|---|
| MYBPC3 | ATGCCTGAGCCGGGGAAGAAGCCAGTCTCAGCTTTTAGCAAGAAGCCACGGTCAGTGGA<br>AGTGGCCGCAGGCAGCCCTGCCGTGTTCGAGGCCGAGACAGAGCGGGCAGGAGTGAAGG<br>TGCGCTGGCAGCGCGGAGGCAGTGACATCAGCGCCAGCAACAAGTACGGCCTGGCCACA<br>GAGGGCACACGGCATACGCTGACAGTGCGGGAAGTGGGCCCTGCCGACCAGGGATCTTA<br>CGCAGTCATTGCTGGCTCCTCCAAGGTCAAGTTCGACCTCAAGGTCATAGAGGCAGAGA<br>AGGCAGAGCCCATGCTGGCCCCTGCCCCTGCCCCTGCTGAGGCCACTGGAGCCCCTGGA<br>GAAGCCCCGGCCCCAGCCGCTGAGCTGGGAGAAAGTGCCCCAAGTCCCAAAGGGTCAAG<br>CTCAGCAGCTCTCAATGGTCCTACCCCTGGAGCCCCGATGACCCCATTGGCCTCTTCG<br>TGATGCGGCCACAGGATGGCGAGGTGACCGTGGGTGGCAGCATCACCTTCTCAGCCCGC<br>GTGGCCGGCGCCAGCCTCCTGAAGCCGCTGTGGTCAAGTGGTTCAAGGGCAAATGGGT<br>GGACCTGAGCAGCAAGGTGGGCCAGCACCTGCAGCTGCACGACAGCTACGACCGCGCCA<br>GCAAGGTCTATCTGTTCGAGCTGCACATCACCGATGCCCAGCCTGCCTTCACTGGCAGC<br>TACCGCTGTGAGGTGTCCACCAAGGACAAATTTGACTGCTCCAACTTCAATCTCACTGT | 86 |

TABLE 4A-continued

Illustrative MYBPC3 Polynucleotide Sequences

| Name | DNA Sequence | SEQ ID NO. |
|---|---|---|
| | CCACGAGGCCATGGGCACCGGAGACCTGGACCTCCTATCAGCCTTCCGCCGCACGAGCC<br>TGGCTGGAGGTGGTCGGCGGATCAGTGATAGCCATGAGGACACTGGGATTCTGGACTTC<br>AGCTCACTGCTGAAAAAGAGAGACAGTTTCCGGACCCCGAGGGACTCGAAGCTGGAGGC<br>ACCAGCAGAGGAGGACGTGTGGGAGATCCTACGGCAGGCACCCCCATCTGAGTACGAGC<br>GCATCGCCTTCCAGTACGGCGTCACTGACCTGCGCGGCATGCTAAAGAGGCTCAAGGGC<br>ATGAGGCGCGATGAGAAGAAGAGCACAGCCTTTCAGAAGAAGCTGGAGCCGGCCTACCA<br>GGTGAGCAAAGGCCACAAGATCCGGCTGACCGTGGAACTGGCTGACCATGACGCTGAGG<br>TCAAATGGCTCAAGAATGGCCAGGAGATCCAGATGAGCGGCAGCAAGTACATCTTTGAG<br>TCCATCGGTGCCAAGCGTACCCTGACCATCAGCCAGTGCTCATTGGCGGACGACGCAGC<br>CTACCAGTGCGTGGTGGGTGGCGAGAAGTGTAGCACGGAGCTCTTTGTGAAAGAGCCCC<br>CTGTGCTCATCACGCGCCCCTTGGAGGACCAGCTGGTGATGGTGGGGCAGCGGGTGGAG<br>TTTGAGTGTGAAGTATCGGAGGAGGGGGCGCAAGTCAAATGGCTGAAGGACGGGGTGGA<br>GCTGACCCGGGAGGAGACCTTCAAATACCGGTTCAAGAAGGACGGGCAGAGACACCACC<br>TGATCATCAACGAGGCCATGCTGGAGGACGCGGGGCACTATGCACTGTGCACTAGCGGG<br>GGCCAGGCGCTGGCTGAGCTCATTGTGCAGGAAAAGAAGCTGGAGGTGTACCAGAGCAT<br>CGCAGACCTGATGGTGGGCGCAAAGGACCAGGCGGTGTTCAAATGTGAGGTCTCAGATG<br>AGAATGTTCGGGGTGTGTGGCTGAAGAATGGGAAGGAGCTGGTGCCCGACAGCCGCATA<br>AAGGTGTCCCACATCGGGCGGGTCCACAAACTGACCATTGACGACGTCACACCTGCCGA<br>CGAGGCTGACTACAGCTTTGTGCCCGAGGGCTTCGCCTGCAACCTGTCAGCCAAGCTCC<br>ACTTCATGGAGGTCAAGATTGACTTCGTACCCAGGCAGGAACCTCCCAAGATCCACCTG<br>GACTGCCCAGGCCGCATACCAGACACCATTGTGGTTGTAGCTGGAAATAAGCTACCTCT<br>GGACGTCCCTATCTCTGGGGACCCCGCTCCCACTGTGATCTGGCAGAAAGGCTATCACGC<br>AGGGGAATAAGGCCCCAGCCAGGCCAGCCCCAGATGCCCCAGAGGACACAGGTGACAGC<br>GATGAGTGGGTGTTTGACAAGAAGCTGCTGTGTGAGACCGAGGGCCGGGTCCGCGTGGA<br>GACCACCAAGGACCGCAGCATCTTCACGGTCGAGGGGGCAGAGAAGGAAGATGAGGGCG<br>TCTACACGGTCACAGTGAAGAACCCTGTGGGCGAGGACCAGGTCAACCTCACAGTCAAG<br>GTCATCGACGTGCCAGACGCACCTGCGGCCCCCAAGATCAGCAACGTGGGAGAGGACTC<br>CTGCACAGTACAGTGGGAGCCGCCTGCCTACGATGGCGGGCAGCCCATCCTGGGCTACA<br>TCCTGGAGCGCAAGAAGAAGAAGAGCTACCGGTGGATGCGGCTGAACTTCGACCTGATT<br>CAGGAGCTGAGTCATGAAGCGCGGCGCATGATCGAGGGCGTGGTGTACGAGATGCGCGT<br>CTACGCGGTCAACGCCATCGGCATGTCCAGGCCCAGCCCTGCCTCCCAGCCCTTCATGC<br>CTATCGGTCCCCCCAGCGAACCCACCCACCTGGCAGTAGAGGACGTCTCTGACACCACG<br>GTCTCCCTCAAGTGGCGGCCCCCAGAGCGCGTGGGAGCAGGAGGCCTGGATGGCTACAG<br>CGTGGAGTACTGCCCAGAGGGCTGCTCAGAGTGGGTGGCTGCCCTGCAGGGGCTGACAG<br>AGCACACATCGATACTGGTGAAGGACCTGCCCACGGGGGCCCGGCTGCTTTTCCGAGTG<br>CGGGCACACAATATGGCAGGGCCTGGAGCCCCTGTTACCACCACGGAGCCGGTGACAGT<br>GCAGGAGATCCTGCAACGGCCACGGCTTCAGCTGCCCAGGCACCTGCGCCAGACCATTC<br>AGAAGAAGGTCGGGGAGCCTGTGAACCTTCTCATCCCCTTTCCAGGGCAAGCCCCGGCCT<br>CAGGTGACCTGGACCAAAGAGGGGCAGCCCCTGGCAGGCGAGGAGGTGAGCATCCGCAA<br>CAGCCCCACAGACACCATCCTGTTCATCCGGGCCGCTCGCCGCGTGCATTCAGGCACTT<br>ACCAGGTGACGGTGCGCATTGAGAACATGGAGGACAAGGCCACGCTGGTGCTGCAGGTT<br>GTTGACAAGCCAAGTCCTCCCCAGGATCTCCGGGTGACTGACGCCTGGGGTCTTAATGT<br>GGCTCTGGAGTGGAAGCCACCCCAGGATGTCGGCAACACGGAACTCTGGGGGTACACAG<br>TGCAGAAAGCCGACAAGAAGACCATGGAGTGGTTCACCGTCTTGGAGCATTACCGCCGC<br>ACCCACTGCGTGGTGCCAGAGCTCATCATTGGCAATGGCTACTACTTCCGCGTCTTCAG<br>CCAGAATATGGTTGGCTTTAGTGACAGAGCGGCCACCACCAAGGAGCCCGTCTTTATCC<br>CCAGACCAGGCATCACCTATGAGCCACCCAACTATAAGGCCCTGGACTTCTCCGAGGCC<br>CCAAGCTTCACCCAGCCCCTGGTGAACCGCTCGGTCATCGCGGGCTACACTGCTATGCT<br>CTGCTGTGCTGTCCGGGGTAGCCCCAAGCCCAAGATTTCCTGGTTCAAGAATGGCCTGG<br>ACCTGGGAGAAGACGCCCGCTTCCGCATGTTCAGCAAGCAGGGAGTGTTGACTCTGGAG<br>ATTAGAAAGCCCTGCCCCTTTGACGGGGGCATCTATGTCTGCAGGGCCACCAACTTACA<br>GGGCGAGGCACGGTGTGAGTGCCGCCTGGAGGTGCGAGTGCCTCAGTAA | |
| MYBPC3-delC3 | ATGCCTGAGCCGGGGAAGAAGCCAGTCTCAGCTTTTAGCAAGAAGCCACGGTCAGTGGA<br>AGTGGCCGCAGGCAGCCCTGCCGTGTTCGAGGCCGAGACAGAGCGGGCAGGAGTGAAGG<br>TGCGCTGGCAGCGCGGAGGCAGTGACATCAGCGCCAGCAACAAGTACGGCCTGGCCACA<br>GAGGGCACACGGCATACGCTGACAGTGCGGGAAGTGGGCCCTGCCGACCAGGGATCTTA<br>CGCAGTCATTGCTGGCTCCTCCAAGGTCAAGTTCGACCTCAAGGTCATAGAGGCAGAGA<br>AGGCAGAGCCCATGCTGGCCCCTGCCCCTGCCCCTGCTGAGGCCACTGGAGCCCCTGGA<br>GAAGCCCCGGCCCCAGCCGCTGAGCTGGGAGAAAGTGCCCCAAGTCCCAAAGGGTCAAG<br>CTCAGCAGCTCTCAATGGTCCTACCCCTGGAGCCCCGATGACCCCATTGGCCTCTTCG<br>TGATGCGGCCACAGGATGGCGAGGTGACCGTGGGTGGCAGCATCACCTTCTCAGCCCGC<br>GTGGCCGGCGCCAGCCTCCTGAAGCCGCCTGTGGTCAAGTGGTTCAAGGGCAAATGGGT<br>GGACCTGAGCAGCAAGGTGGGCCAGCACCTGCAGCTGCACGACAGCTACGACCGCGCCA<br>GCAAGGTCTATCTGTTCGAGCTGCACATCACCGATGCCCAGCCTGCCTTCACTGGCAGC<br>TACCGCTGTGAGGTGTCCACCAAGGACAAATTTGACTGCTCCAACTTCAATCTCACTGT<br>CCACGAGGCCATGGGCACCGGAGACCTGGACCTCCTATCAGCCTTCCGCCGCACGAGCC<br>TGGCTGGAGGTGGTCGGCGGATCAGTGATAGCCATGAGGACACTGGGATTCTGGACTTC<br>AGCTCACTGCTGAAAAGAGAGACAGTTTCCGGACCCCGAGGGACTCGAAGCTGGAGGC<br>ACCAGCAGAGGAGGACGTGTGGGAGATCCTACGGCAGGCACCCCCATCTGAGTACGAGC<br>GCATCGCCTTCCAGTACGGCGTCACTGACCTGCGCGGCATGCTAAAGAGGCTCAAGGGC<br>ATGAGGCGCGATGAGAAGAAGAGCACAGCCTTTCAGAAGAAGCTGGAGCCGGCCTACCA<br>GGTGAGCAAAGGCCACAAGATCCGGCTGACCGTGGAACTGGCTGACCATGACGCTGAGG<br>TCAAATGGCTCAAGAATGGCCAGGAGATCCAGATGAGCGGCAGCAAGTACATCTTTGAG<br>TCCATCGGTGCCAAGCGTACCCTGACCATCAGCCAGTGCTCATTGGCGGACGACGCAGC | 87 |

TABLE 4A-continued

Illustrative MYBPC3 Polynucleotide Sequences

| Name | DNA Sequence | SEQ ID NO. |
|---|---|---|
| | CTACCAGTGCGTGGTGGGTGGCGAGAAGTGTAGCACGGAGCTCTTTGTGAAAGAGCCCC CTGTGTACCAGAGCATCGCAGACCTGATGGTGGGCGCAAAGGACCAGGCGGTGTTCAAA TGTGAGGTCTCAGATGAGAATGTTCGGGGTGTGTGGCTGAAGAATGGGAAGGAGCTGGT GCCCGACAGCCGCATAAAGGTGTCCCACATCGGGCGGGTCCACAAACTGACCATTGACG ACGTCACACCTGCCGACGAGGCTGACTACAGCTTTGTGCCCGAGGGCTTCGCCTGCAAC CTGTCAGCCAAGCTCCACTTCATGGAGGTCAAGATTGACTTCGTACCCAGGCAGGAACC TCCCAAGATCCACCTGGACTGCCCAGGCCGCATACCAGACACCATTGTGGTTGTAGCTG GAAATAAGCTACGTCTGGACGTCCCTATCTCTGGGGACCCCGCTCCCACTGTGATCTGG CAGAAGGCTATCACGCAGGGGAATAAGGCCCCAGCCAGGCCAGCCCCAGATGCCCCAGA GGACACAGGTGACAGCGATGAGTGGGTGTTTGACAAGAAGCTGCTGTGTGAGACCGAGG GCCGGGTCCGCGTGGAGACCACCAAGGACCGCAGCATCTTCACGGTCGAGGGGCAGAG AAGGAAGATGAGGGCGTCTACACGGTCACAGTGAAGAACCCTGTGGGCGAGGACCAGGT CAACCTCACAGTCAAGGTCATCGACGTGCCAGACGCACCTGCGGCCCCCAAGATCAGCA ACGTGGGAGAGGACTCCTGCACAGTACAGTGGGAGCCGCCTGCCTACGATGGCGGGCAG CCCATCCTGGGCTACATCCTGGAGCGCAAGAAGAAGAAGAGCTACCGGTGGATGCGGCT GAACTTCGACCTGATTCAGGAGCTGAGTCATGAAGCGCGGCACGATGATCGAGGGCGTGG TGTACGAGATGCGCGTCTACGCGGTCAACGCCATCGGCATGTCCAGGCCCAGCCCTGCC TCCCAGCCCTTCATGCCTATCGGTCCCCCCAGCGAACCCACCCACCTGGCAGTAGAGGA CGTCTCTGACACCACGGTCTCCCTCAAGTGGCGGCCCCCAGAGCGCGTGGGAGCAGGAG GCCTGGATGGCTACAGCGTGGAGTACTGCCCAGAGGGCTGCTCAGAGTGGGTGGCTGCC CTGCAGGGGCTGACAGAGCACACATCGATACTGGTGAAGGACCTGCCCACGGGGGCCCG GCTGCTTTTCCGAGTGCGGGCACACAATATGGCAGGGCTGGAGCCCCTGTTACCACCA CGGAGCCGGTGACAGTGCAGGAGATCCTGCAACGGCCACGGCTTCAGCTGCCCAGGCAC CTGCGCCAGACCATTCAGAAGAAGGTCGGGGAGCCTGTGAACCTTCTCATCCCTTTCCA GGGCAAGCCCCGGCCTCAGGTGACCTGGACCAAAGAGGGGCAGCCCCTGGCAGGCGAGG AGGTGAGCATCCGCAACAGCCCCACAGACACCATCCTGTTCATCCGGGCCGCTCGCCGC GTGCATTCAGGCACTTACCAGGTGACGGTGCGCATTGAGAACATGGAGGACAAGGCCAC GCTGGTGCTGCAGGTTGTTGACAAGCCAAGTCCTCCCCAGGATCTCCGGGTGACTGACG CCTGGGGTCTTAATGTGGCTCTGGAGTGGAAGCCACCCCAGGATGTCGGCAACACGGAA CTCTGGGGGTACAGTGCAGAAAGCCGACAAGAAGACCATGGAGTGGTTCACCGTCTT GGAGCATTACCGCCGCACCCACTGCGTGGTGCCAGAGCTCATCATTGGCAATGGCTACT ACTTCCGCGTCTTCAGCCAGAATATGGTTGGCTTTAGTGACAGAGCGGCCACCACCAAG GAGCCCGTCTTTATCCCCAGACCAGGCATCACCTATGAGCCACCCAACTATAAGGCCCT GGACTTCTCCGAGGCCCCAAGCTTCACCCAGCCCCTGGTGAACCGCTCGGTCATCGCGG GCTACACTGCTATGCTCTGCTGTGCTGTCCGGGGTAGCCCCAAGCCCAAGATTTCCTGG TTCAAGAATGGCCTGGACCTGGGAGAAGACGCCCGCTTCCGCATGTTCAGCAAGCAGGG AGTGTTGACTCTGGAGATTAGAAAGCCCTGCCCCTTTGACGGGGGCATCTATGTCTGCA GGGCCACCAACTTACAGGGCGAGGCACGGTGTGAGTGCCGCCTGGAGGTGCAGTGCCT CAGTAA | |
| MYBPC3-delC4 | ATGCCTGAGCCGGGGAAGAAGCCAGTCTCAGCTTTTAGCAAGAAGCCACGGTCAGTGGA AGTGGCCGCAGGCAGCCCTGCCGTGTTCGAGGCCGAGACAGAGCGGGCAGGAGTGAAGG TGCGCTGGCAGCGCGGAGGCAGTGACATCAGCGCCAGCAACAAGTACGGCCTGGCCACA GAGGGCACACGGCATACGCTGACAGTGCGGGAAGTGGGCCCTGCCGACCAGGGATCTTA CGCAGTCATTGCTGGCTCCTCCAAGGTCAAGTTCGACCTCAAGGTCATAGAGGCAGAGA AGGCAGAGCCCATGCTGGCCCCTGCCCCTGCCCCTGCTGAGGCCACTGGAGCCCCTGGA GAAGCCCCGGCCCAGCCGCTGAGCTGGGAGAAAGTGCCCCAAGTCCCAAAGGGTCAAG CTCAGCAGCTCTCAATGGTCCTACCCCTGGAGCCCCGATGACCCCATTGGCCTCTTCG TGATGCGGCCACAGGATGGCGAGGTGACCGTGGGTGGCAGCATCACCTTCTCAGCCCGC GTGGCCGGCGCCAGCCTCCTGAAGCCGCCTGTGGTCAAGTGGTTCAAGGGCAAATGGGT GGACCTGAGCAGCAAGGTGGGCCAGCACCTGCAGCTGCACGACAGCTACGACCGCGCCA GCAAGGTCTATCTGTTCGAGCTGCACATCACCGATGCCCAGCCTGCCTTCACTGGCAGC TACCGCTGTGAGGTGTCCACCAAGGACAAATTTGACTGCTCCAACTTCAATCTCACTGT CCACGAGGCCATGGGCACCGGAGACCTGGACCTCCTATCAGCCTTCCGCCGCACGAGCC TGGCTGGAGGTGGTCGGCGGATCAGTGATAGCCATGAGGACACTGGGATTCTGGACTTC AGCTCACTGCTGAAAAGAGAGACAGTTTCCGGACCCCGAGGGACTCGAAGCTGGAGGC ACCAGCAGAGGAGGACGTGTGGGAGATCCTACGGCAGGCACCCCCATCTGAGTACGAGC GCATCGCCTTCCAGTACGGCGTCACTGACCTGCGCGGCATGCTAAAGAGGCTCAAGGGC ATGAGGCGCGATGAGAAGAAGAGCACAGCCTTTCAGAAGAAGCTGGAGCCGGCCTACCA GGTGAGCAAAGGCCACAAGATCCGGCTGACCGTGGAACTGGCTGACCATGACGCTGAGG TCAAATGGCTCAAGAATGGCCAGGAGATCCAGATGAGCGGCAGCAAGTACATCTTTGAG TCCATCGGTGCCAAGCGTACCCTGACCATCAGCCAGTGCTCATTGGCGGACGACGCAGC CTACCAGTGCGTGGTGGGTGGCGAGAAGTGTAGCACGGAGCTCTTTGTGAAAGAGCCCC CTGTGCTCATCACGCGCCCCTTGGAGGACCAGCTGGTGATGGTGGGCAGCGGGTGGAG TTTGAGTGTGAAGTATCGGAGGAGGGGCGCAAGTCAAATGGCTGAAGGACGGGGTGGA GCTGACCCGGGAGGAGACCTTCAAATACCGGTTCAAGAAGGACGGGCAGAGACACCACC TGATCATCAACGAGGCCATGCTGGAGGACGCGGGCACTATGCACTGTGCACTAGCGGG GGCCAGGCGCTGGCTGAGCTCATTGTGCAGGAAAAGAAGCTGGAGCCTCCAAGATCCA CCTGGACTGCCCAGGCCGCATACCAGACACCATTGTGGTTGTAGCTGGAAATAAGCTAC GTCTGGACGTCCCTATCTCTGGGGACCCCGCTCCCACTGTGATCTGGCAGAAGGCTATC ACGCAGGGGAATAAGGCCCCAGCCAGGCCAGCCCCAGATGCCCCAGAGGACACAGGTGA CAGCGATGAGTGGGTGTTTGACAAGAAGCTGCTGTGTGAGACCGAGGGCCGGGTCCGCG TGGAGACCACCAAGGACCGCAGCATCTTCACGGTCGAGGGGCAGAAGGAAGATGAG GGCGTCTACACGGTCACAGTGAAGAACCCTGTGGGCGAGGACCAGGTCAACCTCACAGT CAAGGTCATCGACGTGCCAGACGCACCTGCGGCCCCCAAGATCAGCAACGTGGGAGAGG | 88 |

TABLE 4A-continued

Illustrative MYBPC3 Polynucleotide Sequences

| Name | DNA Sequence | SEQ ID NO. |
|---|---|---|
| | ACTCCTGCACAGTACAGTGGGAGCCGCCTGCCTACGATGGCGGGCAGCCCATCCTGGGC<br>TACATCCTGGAGCGCAAGAAGAAGAAGAGCTACCGGTGGATGCGGCTGAACTTCGACCT<br>GATTCAGGAGCTGAGTCATGAAGCGCGGCGCATGATCGAGGGCGTGGTGTACGAGATGC<br>GCGTCTACGCGGTCAACGCCATCGGCATGTCCAGGCCCAGCCCTGCCTCCCAGCCCTTC<br>ATGCCTATCGGTCCCCCAGCGAACCCACCCACCTGGCAGTAGAGGACGTCTCTGACAC<br>CACGGTCTCCCTCAAGTGGCGGCCCCAGAGCGCGTGGGAGCAGGAGGCCTGGATGGCT<br>ACAGCGTGGAGTACTGCCCAGAGGGCTGCTCAGAGTGGGTGGCTGCCCTGCAGGGGCTG<br>ACAGAGCACACACATCGATACTGGTGAAGGACCTGCCCACGGGGGCCCGGCTGCTTTTCCG<br>AGTGCGGGCACACAATATGGCAGGGCCTGGAGCCCCTGTTACCACCACGGAGCCGGTGA<br>CAGTGCAGGAGATCCTGCAACGGCCACGGCTTCAGCTGCCCAGGCACCTGCGCCAGACC<br>ATTCAGAAGAAGGTCGGGGAGCCTGTGAACCTTCTCATCCCTTTCCAGGGCAAGCCCCG<br>GCCTCAGGTGACCTGGACCAAAGAGGGGCAGCCCTGGCAGGCGAGGAGGTGAGCATCC<br>GCAACAGCCCCACAGACACCATCCTGTTCATCCGGGCCGCTCGCCGCGTGCATTCAGGC<br>ACTTACCAGGTGACGGTGCGCATTGAGAACATGGAGGACAAGGCCACGCTGGTGCTGCA<br>GGTTGTTGACAAGCCAAGTCCTCCCCAGGATCTCCGGGTGACTGACGCCTGGGGTCTTA<br>ATGTGGCTCTGGAGTGGAAGCCACCCCAGGATGTCGGCAACACGGAACTCTGGGGGTAC<br>ACAGTGCAGAAAGCCGACAAGAAGACCATGGAGTGGTTCACCGTCTTGGAGCATTACCG<br>CCGCACCCACTGCGTGGTGCCAGAGCTCATCATTGGCAATGGCTACTACTTCCGCGTCT<br>TCAGCCAGAATATGGTTGGCTTTAGTGACAGAGCGGCCACCACCAAGGAGCCCGTCTTT<br>ATCCCCAGACCAGGCATCACCTATGAGCCACCCAACTATAAGGCCCTGGACTTCTCCGA<br>GGCCCCAAGCTTCACCCAGCCCCTGGTGAACCGCTCGGTCATCGCGGGCTACACTGCTA<br>TGCTCTGCTGTGCTGTCCGGGGTAGCCCCAAGCCCAAGATTTCCTGGTTCAAGAATGGC<br>CTGGACCTGGGAGAAGACGCCCGCTTCCGCATGTTCAGCAAGCAGGGAGTGTTGACTCT<br>GGAGATTAGAAAGCCCTGCCCCTTTGACGGGGGCATCTATGTCTGCAGGGCCACCAACT<br>TACAGGGCGAGGCACGGTGTGAGTGCCGCCTGGAGGTGCGAGTGCCTCAGTAA | |
| MYBPC3-<br>delC4b | ATGCCTGAGCCGGGGAAGAAGCCAGTCTCAGCTTTTAGCAAGAAGCCACGGTCAGTGGA<br>AGTGGCCGCAGGCAGCCCTGCCGTGTTCGAGGCCGAGACAGAGCGGGCAGGAGTGAAGG<br>TGCGCTGGCAGCGCGGAGGCAGTGACATCAGCGCCAGCAACAAGTACGGCCTGGCCACA<br>GAGGGCACACGGCATACGCTGACAGTGCGGGAAGTGGGCCCTGCCGACCAGGGATCTTA<br>CGCAGTCATTGCTGGCTCCTCCAAGGTCAAGTTCGACCTCAAGGTCATAGAGGCAGAGA<br>AGGCAGAGCCCATGCTGGCCCCTGCCCCTGCCCCTGCTGAGGCCACTGGAGCCCCTGGA<br>GAAGCCCCGGCCCCAGCCGCTGAGCTGGGAGAAAGTGCCCCAAGTCCCAAAGGGTCAAG<br>CTCAGCAGCTCTCAATGGTCCTACCCCTGGAGCCCCCGATGACCCCATTGGCCTCTTCG<br>TGATGCGGCCACAGGATGGCGAGGTGACCGTGGGTGGCAGCATCACCTTCTCAGCCCGC<br>GTGGCCGGCGCCAGCCTCCTGAAGCCGCCTGTGGTCAAGTGGTTCAAGGGCAAATGGGT<br>GGACCTGAGCAGCAAGGTGGGCCAGCACCTGCAGCTGCACGACAGCTACGACCGCGCCA<br>GCAAGGTCTATCTGTTCGAGCTGCACATCACCGATGCCCAGCCTGCCTTCACTGGCAGC<br>TACCGCTGTGAGGTGTCCACCAAGGACAAATTTGACTGCTCCAACTTCAATCTCACTGT<br>CCACGAGGCCATGGGCACCGGAGACCTGGACCTCCTATCAGCCTTCCGCCGCACGAGCC<br>TGGCTGGAGGTGGTCGGCGGATCAGTGATAGCCATGAGGACACTGGGATTCTGGACTTC<br>AGCTCACTGCTGAAAAAGAGAGACAGTTTCCGGACCCCGAGGGACTCGAAGCTGGAGGC<br>ACCAGCAGAGGAGGACGTGTGGGAGATCCTACGGCAGGCACCCCCATCTGAGTACGAGC<br>GCATCGCCTTCCAGTACGGCGTCACTGACCTGCGCGGCATGCTAAAGAGGCTCAAGGGC<br>ATGAGGCGCGATGAGAAGAAGAGCACAGCCTTTCAGAAGAAGCTGGAGCCGGCCTACCA<br>GGTGAGCAAAGGCCACAAGATCCGGCTGACCGTGGAACTGGCTGACCATGACGCTGAGG<br>TCAAATGGCTCAAGAATGGCCAGGAGATCCAGATGAGCGGCAGCAAGTACATCTTTGAG<br>TCCATCGGTGCCAAGCGTACCCTGACCATCAGCCAGTGCTCATTGGCGGACGACGCAGC<br>CTACCAGTGCGTGGTGGGTGGCGAGAAGTGTAGCACGGAGCTCTTTGTGAAAGAGCCCC<br>CTGTGCTCATCACGCGCCCCTTGGAGGACCAGCTGGTGATGGTGGGCAGCGGGTGGAG<br>TTTGAGTGTGAAGTATCGGAGGAGGGGCGCAAGTCAAATGGCTGAAGGACGGGGTGGA<br>GCTGACCCGGGAGGAGACCTTCAAATACCGGTTCAAGAAGGACGGGCAGAGACACCACC<br>TGATCATCAACGAGGCCATGCTGGAGGACGCGGGGCACTATGCACTGTGCACTAGCAGG<br>GGCCAGGCGCTGGCTGAGCTCATTGTGCAGGAAAAGAAGCTGGAGCCCAGGCAGGAACC<br>TCCCAAGATCCACCTGGACTGCCCAGGCCGCATACCAGACACCATTGTGGTTGTAGCTG<br>GAAATAAGCTACGTCTGGACGTCCCTATCTCTGGGGACCCCGCTCCCACTGTGATCTGG<br>CAGAAGGCTATCACGCAGGGGAATAAGGCCCCAGCCAGGCCAGCCCCAGATGCCCCAGA<br>GGACACAGGTGACAGCGATGAGTGGGTGTTTGACAAGAAGCTGCTGTGTGAGACCGAGG<br>GCCGGGTCCGCGTGGAGACCACCAAGGACCGCAGCATCTTCACGGTCGAGGGGCAGAG<br>AAGGAAGATGAGGGCGTCTACACGGTCACAGTGAAGAACCCGTGGGCGAGGACCAGGT<br>CAACCTCACAGTCAAGGTCATCGACGTGCCAGACGCACCTGCGGCCCCAAGATCAGCA<br>ACGTGGGAGAGGACTCCTGCACAGTACAGTGGGAGCCGCCTGCCTACGATGGCGGGCAG<br>CCCATCCTGGGCTACATCCTGGAGCGCAAGAAGAAGAAGAGCTACCGGTGGATGCGGCT<br>GAACTTCGACCTGATTCAGGAGCTGAGTCATGAAGCGCGGCGCATGATCGAGGGCGTGG<br>TGTACGAGATGCGCGTCTACGCGGTCAACGCCATCGGCATGTCCAGGCCCAGCCCTGCC<br>TCCCAGCCCTTCATGCCTATCGGTCCCCCAGCGAACCCACCCACCTGGCAGTAGAGGA<br>CGTCTCTGACACCACGGTCTCCCTCAAGTGGCGGCCCCAGAGCGCGTGGGAGCAGGAG<br>GCCTGGATGGCTACAGCGTGGAGTACTGCCCAGAGGGCTGCTCAGAGTGGGTGGCTGCC<br>CTGCAGGGGCTGACAGAGCACACATCGATACTGGTGAAGGACCTGCCCACGGGGCCCG<br>GCTGCTTTTCCGAGTGCGGGCACACAATATGGCAGGGCCTGGAGCCCCTGTTACCACCA<br>CGGAGCCGGTGACAGTGCAGGAGATCCTGCAACGGCCACGGCTTCAGCTGCCCAGGCAC<br>CTGCGCCAGACCATTCAGAAGAAGGTCGGGGAGCCTGTGAACCTTCTCATCCCTTTCCA<br>GGGCAAGCCCCGGCCTCAGGTGACCTGGACCAAAGAGGGGCAGCCCTGGCAGGCGAGG<br>AGGTGAGCATCCGCAACAGCCCCACAGACACCATCCTGTTCATCCGGGCCGCTCGCCGC<br>GTGCATTCAGGCACTTACCAGGTGACGGTGCGCATTGAGAACATGGAGGACAAGGCCAC | 89 |

TABLE 4A-continued

Illustrative MYBPC3 Polynucleotide Sequences

| Name | DNA Sequence | SEQ ID NO. |
|---|---|---|
| | GCTGGTGCTGCAGGTTGTTGACAAGCCAAGTCCTCCCCAGGATCTCCGGGTGACTGACG<br>CCTGGGGTCTTAATGTGGCTCTGGAGTGGAAGCCACCCCAGGATGTCGGCAACACGGAA<br>CTCTGGGGGTACACAGTGCAGAAAGCCGACAAGAAGACCATGGAGTGGTTCACCGTCTT<br>GGAGCATTACCGCCGCACCCACTGCGTGGTGCCAGAGCTCATCATTGGCAATGGCTACT<br>ACTTCCGCGTCTTCAGCCAGAATATGGTTGGCTTTAGTGACAGAGCGGCCACCACCAAG<br>GAGCCCGTCTTTATCCCCAGACCAGGCATCACCTATGAGCCACCCAACTATAAGGCCCT<br>GGACTTCTCCGAGGCCCCAAGCTTCACCCAGCCCCTGGTGAACCGCTCGGTCATCGCGG<br>GCTACACTGCTATGCTCTGCTGTGCTGTCCGGGGTAGCCCCAAGCCCAAGATTTCCTGG<br>TTCAAGAATGGCCTGGACCTGGGAGAAGACGCCCGCTTCCGCATGTTCAGCAAGCAGGG<br>AGTGTTGACTCTGGAGATTAGAAAGCCCTGCCCCTTTGACGGGGGCATCTATGTCTGCA<br>GGGCCACCAACTTACAGGGCGAGGCACGGTGTGAGTGCCGCCTGGAGGTGCGAGTGCCT<br>CAGTAA | |

TABLE 4B

Illustrative MYBPC3 Protein Sequences

| Name | Protein Sequence | SEQ ID NO. |
|---|---|---|
| MYBPC3 | MPEPGKKPVSAFSKKPRSVEVAAGSPAVFEAETERAGVKVRWQRGGSDISASNKYGLAT<br>EGTRHTLTVREVGPADQGSYAVIAGSSKVKFDLKVIEAEKAEPMLAPAPAPAEATGAPG<br>EAPAPAAELGESAPSPKGSSSAALNGPTPGAPDDPIGLFVMRPQDGEVTVGGSITFSAR<br>VAGASLLKPPVVKWFKGKWVDLSSKVGQHLQLHDSYDRASKVYLFELHITDAQPAFTGS<br>YRCEVSTKDKEDCSNENLTVHEAMGTGDLDLLSAFRRTSLAGGGRRISDSHEDTGILDF<br>SSLLKKRDSFRTPRDSKLEAPAEEDVWEILRQAPPSEYERIAFQYGVTDLRGMLKRLKG<br>MRRDEKKSTAFQKKLEPAYQVSKGHKIRLTVELADHDAEVKWLKNGQEIQMSGSKYIFE<br>SIGAKRTLTISQCSLADDAAYQCVVGGEKCSTELFVKEPPVLITRPLEDQLVMVGQRVE<br>FECEVSEEGAQVKWLKDGVELTREETFKYRFKKDGQRHHLIINEAMLEDAGHYALCTSG<br>GQALAELIVQEKKLEVYQSIADLMVGAKDQAVEKCEVSDENVRGVWLKNGKELVPDSRI<br>KVSHIGRVHKLTIDDVTPADEADYSFVPEGFACHLSAKLHEMEVKIDFVPRQEPPKIHL<br>DCPGRIPDTIVVVAGNKLRLDVPISGDPAPTVIWQKAITGGNKAPARPAPDAPEDTGDS<br>DEWVFDKKLLCETEGRVRVETTKDRSIFTVEGAEKEDEGVYTVTVKNPVGEDQVNLTVK<br>VIDVPDAPAAPKISNVGEDSCTVQWEPPAYDGGQPILGYILERKKKKSYRWMRLNFDLI<br>QELSHEARRMIEGVVYEMRVYAVNAIGMSRPSPASQPFMPIGPPSEPTHLAVEDVSDTT<br>VSLKWRPPERVGAGGLDGYSVEYCPEGCSEWVAALQGLTEHTSILVKDLPTGARLLFRV<br>RAHNMAGPGAPVTTTEPVTVQEILQRPRLQLPRHLRQTIQKKVGEPVNLLIPFQGKPRP<br>QVTWTKEGQPLAGEEVSIRNSPTDTILFIRAARRVHSGTYQVTVRIENMEDKATLVLQV<br>VDKPSPPQDLRVTDAWGLNVALEWKPPQDVGNTELWGYTVQKADKKTMEWFTVLEHYRR<br>THCVVPELIIGNGYYFRVESQNMVGESDRAATTKEPVFIPRPGITYEPPNYKALDFSEA<br>PSFTQPLVNRSVIAGYTAMLCCAVRGSPKPKISWEKNGLDLGEDARFRMESKQGVLTLE<br>IRKPCPFDGGIYVCRATNLQGEARCECRLEVRVPQ | 103 |
| MYBPC3-delC3 | MPEPGKKPVSAFSKKPRSVEVAAGSPAVFEAETERAGVKVRWQRGGSDISASNKYGLAT<br>EGTRHTLTVREVGPADQGSYAVIAGSSKVKFDLKVIEAEKAEPMLAPAPAPAEATGAPG<br>EAPAPAAELGESAPSPKGSSSAALNGPTPGAPDDPIGLFVMRPQDGEVTVGGSITFSAR<br>VAGASLLKPPVVKWFKGKWVDLSSKVGQHLQLHDSYDRASKVYLFELHITDAQPAFTGS<br>YRCEVSTKDKEDCSNENLTVHEAMGTGDLDLLSAFRRTSLAGGGRRISDSHEDTGILDF<br>SSLLKKRDSFRTPRDSKLEAPAEEDVWEILRQAPPSEYERIAFQYGVTDLRGMLKRLKG<br>MRRDEKKSTAFQKKLEPAYQVSKGHKIRLTVELADHDAEVKWLKNGQEIQMSGSKYIFE<br>SIGAKRTLTISQCSLADDAAYQCVVGGEKCSTELFVKEPPVYQSIADLMVGAKDQAVEK<br>CEVSDENVRGVWLKNGKELVPDSRIKVSHIGRVHKLTIDDVTPADEADYSFVPEGFACN<br>LSAKLHFMEVKIDFVPRQEPPKIHLDCPGRIPDTIVVVAGNKLRLDVPISGDPAPTVIW<br>QKAITGGNKAPARPAPDAPEDTGDSDEWVFDKKLLCETEGRVRVETTKDRSIFTVEGAE<br>KEDEGVYTVTVKNPVGEDQVNLTVKVIDVPDAPAAPKISNVGEDSCTVQWEPPAYDGGQ<br>PILGYILERKKKKSYRWMRLNFDLIQELSHEARRMIEGVVYEMRVYAVNAIGMSRPSPA<br>SQPFMPIGPPSEPTHLAVEDVSDTTVSLKWRPPERVGAGGLDGYSVEYCPEGCSEWVAA<br>LQGLTEHTSILVKDLPTGARLLFRVRAHNMAGPGAPVTTTEPVTVQEILQRPRLQLPRH<br>LRQTIQKKVGEPVNLLIPFQGKPRPQVTWTKEGQPLAGEEVSIRNSPTDTILFIRAARR<br>VHSGTYQVTVRIENMEDKATLVLQVVDKPSPPQDLRVTDAWGLNVALEWKPPQDVGNTE<br>LWGYTVQKADKKTMEWFTVLEHYRRTHCVVPELIIGNGYYFRVESQNMVGESDRAATTK<br>EPVFIPRPGITYEPPNYKALDFSEAPSFTQPLVNRSVIAGYTAMLCCAVRGSPKPKISW<br>FKNGLDLGEDARFRMESKQGVLTLEIRKPCPFDGGIYVCRATNLQGEARCECRLEVRVP<br>Q | 104 |
| MYBPC3-delC4 | MPEPGKKPVSAFSKKPRSVEVAAGSPAVFEAETERAGVKVRWQRGGSDISASNKYGLAT<br>EGTRHTLTVREVGPADQGSYAVIAGSSKVKFDLKVIEAEKAEPMLAPAPAPAEATGAPG<br>EAPAPAAELGESAPSPKGSSSAALNGPTPGAPDDPIGLFVMRPQDGEVTVGGSITFSAR<br>VAGASLLKPPVVKWFKGKWVDLSSKVGQHLQLHDSYDRASKVYLFELHITDAQPAFTGS<br>YRCEVSTKDKEDCSNENLTVHEAMGTGDLDLLSAFRRTSLAGGGRRISDSHEDTGILDF<br>SSLLKKRDSFRTPRDSKLEAPAEEDVWEILRQAPPSEYERIAFQYGVTDLRGMLKRLKG<br>MRRDEKKSTAFQKKLEPAYQVSKGHKIRLTVELADHDAEVKWLKNGQEIQMSGSKYIFE | 105 |

TABLE 4B-continued

Illustrative MYBPC3 Protein Sequences

| Name | Protein Sequence | SEQ ID NO. |
|---|---|---|
| | SIGAKRTLTISQCSLADDAAYQCVVGGEKCSTELFVKEPPVLITRPLEDQLVMVGQRVE FECEVSEEGAQVKWLKDGVELTREETFKYRFKKDGQRHHLIINEAMLEDAGHYALCTSG GQALAELIVQEKKLEPPKIHLDCPGRIPDTIVVVAGNKLRLDVPISGDPAPTVIWQKAI TQGNKAPARPAPDAPEDTGDSDEWVFDKKLLCETEGRVRVETTKDRSIFTVEGAEKEDE GVYTVTVKNPVGEDQVNLTVKVIDVPDAPAAPKISNVGEDSCTVQWEPPAYDGGQPILG YILERKKKKSYRWMRLNFDLIQELSHEARRMIEGVVYEMRVYAVNAIGMSRPSPASQPF MPIGPPSEPTHLAVEDVSDTTVSLKWRPPERVGAGGLDGYSVEYCPEGCSEWVAALQGL TEHTSILVKDLPTGARLLFRVRAHNMAGPGAPVTTTEPVTVQEILQRPRLQLPRHLRQT IQKKVGEPVNLLIPFQGKPRPQVTWTKEGQPLAGEEVSIRNSPTDTILFIRAARRVHSG TYQVTVRIENMEDKATLVLQVVDKPSPPQDLRVTDAWGLNVALEWKPPQDVGNTELWGY TVQKADKKTMEWFTVLEHYRRTHCVVPELIIGNYYFRVESQNMVGESDRAATTKEPVF IPRPGITYEPPNYKALDFSEAPSFTQPLVNRSVIAGYTAMLCCAVRGSPKPKISWFKNG LDLGEDARFRMESKQGVLTLEIRKPCPFDGGIYVCRATNLQGEARCECRLEVRVPQ | |
| MYBPC3-delC4b | MPEPGKKPVSAFSKKPRSVEVAAGSPAVFEAETERAGVKVRWQRGGSDISASNKYGLAT EGTRHTLTVREVGPADQGSYAVIAGSSKVKFDLKVIEAEKAEPMLAPAPAPAEATGAPG EAPAPAAELGESAPSPKGSSSAALNGPTPGAPDDPIGLFVMRPQDGEVTVGGSITFSAR VAGASLLKPPVVKWFKGKWVDLSSKVGQHLQLHDSYDRASKVYLFELHITDAQPAFTGS YRCEVSTKDKEDCSNENLTVHEAMGTGDLDLLSAFRRTSLAGGGRRISDSHEDTGILDF SSLLKKRDSFRTPRDSKLEAPAEEDVWEILRQAPPSEYERIAFQYGVTDLRGMLKRLKG MRRDEKKSTAFQKKLEPAYQVSKGHKIRLTVELADHDAEVKWLKNGQEIQMSGSKYIFE SIGAKRTLTISQCSLADDAAYQCVVGGEKCSTELFVKEPPVLITRPLEDQLVMVGQRVE FECEVSEEGAQVKWLKDGVELTREETFKYRFKKDGQRHHLIINEAMLEDAGHYALCTSG GQALAELIVQEKKLEPRQEPPKIHLDCPGRIPDTIVVVAGNKLRLDVPISGDPAPTVIW QKAITQGNKAPARPAPDAPEDTGDSDEWVFDKKLLCETEGRVRVETTKDRSIFTVEGAE KEDEGVYTVTVKNPVGEDQVNLTVKVIDVPDAPAAPKISNVGEDSCTVQWEPPAYDGGQ PILGYILERKKKKSYRWMRLNFDLIQELSHEARRMIEGVVYEMRVYAVNAIGMSRPSPA SQPFMPIGPPSEPTHLAVEDVSDTTVSLKWRPPERVGAGGLDGYSVEYCPEGCSEWVAA LQGLTEHTSILVKDLPTGARLLFRVRAHNMAGPGAPVTTTEPVTVQEILQRPRLQLPRH LRQTIQKKVGEPVNLLIPFQGKPRPQVTWTKEGQPLAGEEVSIRNSPTDTILFIRAARR VHSGTYQVTVRIENMEDKATLVLQVVDKPSPPQDLRVTDAWGLNVALEWKPPQDVGNTE LWGYTVQKADKKTMEWFTVLEHYRRTHCVVPELIIGNYYFRVESQNMVGESDRAATTK EPVFIPRPGITYEPPNYKALDFSEAPSFTQPLVNRSVIAGYTAMLCCAVRGSPKPKISW FKNGLDLGEDARFRMESKQGVLTLEIRKPCPFDGGIYVCRATNLQGEARCECRLEVRVP Q | 106 |

In some embodiments, the disclosure provides a vector comprising a polynucleotide sequence that encodes the potassium voltage gated channel subfamily H member 2 (KCNH2) protein, operatively linked to a modified cardiac TNNT2 promoter. Similarly stated, in some embodiments, the polynucleotide sequence operatively linked to the cardiac-specific promoter (e.g., a modified cardiac TNNT2 promoter) is KCNH2, or a mutant, variant, or fragment thereof (e.g., SEQ ID NO: 107). In humans, the KCNH2 gene encodes the KCNH2 protein (also known as hERG1, e.g., SEQ ID NO: 108), which forms a potassium channel with other KCNH2 proteins to transport potassium out of cells. KCHN2 proteins are abundantly expressed in cardiac muscle, which function to recharge the cardiac tissue after each heartbeat to maintain regular rhythm. In some embodiments, the polynucleotide encoding KCNH2 shares at least 90%, 95%, 99%, or 100% identity to SEQ ID NO: 107. In some embodiments, the KCNH2 protein shares at least 90%, 95%, 99%, or 100% identity to SEQ ID NO: 108.

In some embodiments, the disclosure provides a vector comprising a polynucleotide sequence that encodes the transient receptor potential cation channel subfamily M membrane 4 (TRPM4) protein, operatively linked to a modified cardiac TNNT2 promoter. Similarly stated, in some embodiments, the polynucleotide sequence operatively linked to the cardiac-specific promoter (e.g., a modified cardiac TNNT2 promoter) is TRPM4, or a mutant, variant, or fragment thereof (e.g., SEQ ID NO: 109). In humans, the TRPM4 gene encodes the TRPM4 protein (e.g., SEQ ID NO: 110), which functions as a channel to control the flow of cations into and out of cells. The TRPM4 channel is abundantly expressed in cardiac cells and plays a key role in generating and transmitting electrical signals. In some embodiments, the polynucleotide encoding TRPM4 shares at least 90%, 95%, 99%, or 100% identity to SEQ ID NO: 109. In some embodiments, the TRPM4 protein shares at least 90%, 95%, 99%, or 100% identity to SEQ ID NO: 110.

In some embodiments, the disclosure provides a vector comprising a polynucleotide sequence that encodes the desmoglein 2 (DSG2) protein, operatively linked to a modified cardiac TNNT2 promoter. Similarly stated, in some embodiments, the polynucleotide sequence operatively linked to the cardiac-specific promoter (e.g., a modified cardiac TNNT2 promoter) is DSG2, or a mutant, variant, or fragment thereof (e.g., SEQ ID NO: 111). In humans, the DSG2 gene encodes DSG2 protein (e.g., SEQ ID NO: 112), which is a transmembrane glycoprotein and component of desmosomes. Desmosomes are intercellular junctions that provide strong adhesion between cells giving mechanical strength to tissues. In some embodiments, the polynucleotide encoding DSG2 shares at least 90%, 95%, 99%, or 100% identity to SEQ ID NO: 111. In some embodiments, the DSG2 protein shares at least 90%, 95%, 99%, or 100% identity to SEQ ID NO: 112.

In some embodiments, the disclosure provides a vector comprising a polynucleotide sequence that encodes the ATPase sarcoplasmic/endoplasmic reticulum calcium transporting 2 (ATP2A2) protein, operatively linked to a modified cardiac TNNT2 promoter. Similarly stated, in some embodiments, the polynucleotide sequence operatively linked to the cardiac-specific promoter (e.g., a modified TNNT2 promoter) is ATP2A2, or a mutant, variant, or fragment thereof (e.g., SEQ ID NO: 113). In humans, the ATP2A2 gene encodes sarco(endo)plasmic reticulum calcium-ATPase 2 (SERCA2) protein (e.g., SEQ ID NO: 114), which catalyzes the hydrolysis of ATP coupled with the translocation of calcium from the cytosol into the sarcoplasmic reticulum lumen. The regulation of calcium ions into and out of the sarcoplasmic reticulum assists with muscle contraction and relaxation. In some embodiments, the polynucleotide encoding ATP2A2 shares at least 90%, 95%, 99%, or 100% identity to SEQ ID NO: 113. In some embodiments, the ATP2A2 protein shares at least 90%, 95%, 99%, or 100% identity to SEQ ID NO: 114.

In some embodiments, the disclosure provides a vector comprising a polynucleotide sequence that encodes the calcium voltage-gated channel subunit alpha 1C (CACNA1C) protein, operatively linked to a modified cardiac TNNT2 promoter. Similarly stated, in some embodiments, the polynucleotide sequence operatively linked to the cardiac-specific promoter (e.g., a modified TNNT2 promoter) is CACNA1C, or a mutant, variant, or fragment thereof (e.g., SEQ ID NO: 115). In humans, the CACNA1C gene encodes the alpha 1 subunit of a voltage-dependent calcium channel protein (e.g., SEQ ID NO: 116), which functions to mediate the influx of calcium ions into the cell upon membrane polarization. In some embodiments, the polynucleotide encoding CACNA1C shares at least 90%, 95%, 99%, or 100% identity to SEQ ID NO: 115. In some embodiments, the CACNA1C protein shares at least 90%, 95%, 99%, or 100% identity to SEQ ID NO: 116.

In some embodiments, the disclosure provides a vector comprising a polynucleotide sequence that encodes the dystrophin (DMD) protein, operatively linked to a modified cardiac TNNT2 promoter. Similarly stated, in some embodiments, the polynucleotide sequence operatively linked to the cardiac-specific promoter (e.g., a modified TNNT2 promoter) is DMD, or a mutant, variant, or fragment thereof (e.g., SEQ ID NO: 117). In humans, the DMD gene encodes the DMD protein (e.g., SEQ ID NO: 118), which forms a component of the dystrophin-glycoprotein complex (DGC). The DGC acts as an anchor, connecting the cytoskeleton with the extracellular matrix, thereby strengthening muscle fibers and protecting them from injury as muscles contract and relax. In some embodiments, the polynucleotide encoding DMD shares at least 90%, 95%, 99%, or 100% identity to SEQ ID NO: 117. In some embodiments, the DMD protein shares at least 90%, 95%, 99%, or 100% identity to SEQ ID NO: 118.

In some embodiments, the disclosure provides a vector comprising a polynucleotide sequence that encodes the DM1 protein kinase (DMPK) protein, operatively linked to a modified cardiac TNNT2 promoter. Similarly stated, in some embodiments, the polynucleotide sequence operatively linked to the cardiac-specific promoter (e.g., a modified TNNT2 promoter) is DMPK, or a mutant, variant, or fragment thereof (e.g., SEQ ID NO: 119). In humans, the DMPK gene encodes myotonic dystrophy protein kinase protein (e.g., SEQ ID NO: 120), which plays an important role in brain, muscle and heart development and homeostasis. Myotonic dystrophy protein kinase inhibits myosin phosphatase, which plays a role in muscle tensing and relaxation. In some embodiments, the polynucleotide encoding DMPK shares at least 90%, 95%, 99%, or 100% identity to SEQ ID NO: 119. In some embodiments, the DMPK protein shares at least 90%, 95%, 99%, or 100% identity to SEQ ID NO: 120.

In some embodiments, the disclosure provides a vector comprising a polynucleotide sequence that encodes the ectopic P granules protein 5 homolog (EPG5) protein, operatively linked to a modified cardiac TNNT2 promoter. Similarly stated, in some embodiments, the polynucleotide sequence operatively linked to the cardiac-specific promoter (e.g., a modified TNNT2 promoter) is EPG5, or a mutant, variant, or fragment thereof (e.g., SEQ ID NO: 121). In humans, the EPG5 gene encodes the EPG5 protein (e.g., SEQ ID NO: 122), which functions in autophagy to promote the interaction between autophagosomes and lysosomes. In some embodiments, the polynucleotide encoding EPG5 shares at least 90%, 95%, 99%, or 100% identity to SEQ ID NO: 121. In some embodiments, the EPG5 protein shares at least 90%, 95%, 99%, or 100% identity to SEQ ID NO: 122.

In some embodiments, the disclosure provides a vector comprising a polynucleotide sequence that encodes the EvC ciliary complex subunit 1 (EVC) protein, operatively linked to a modified cardiac TNNT2 promoter. Similarly stated, in some embodiments, the polynucleotide sequence operatively linked to the cardiac-specific promoter (e.g., a modified TNNT2 promoter) is EVC, or a mutant, variant, or fragment thereof (e.g., SEQ ID NO: 123). In humans, the EVC gene encodes the EVC protein (e.g., SEQ ID NO: 124), which is found primarily in cilia, and functions to transmit information between cells. The EVC protein also regulates Sonic Hedgehog, which plays a role in cell growth and differentiation. In some embodiments, the polynucleotide encoding EVC shares at least 90%, 95%, 99%, or 100% identity to SEQ ID NO: 123. In some embodiments, the EVC protein shares at least 90%, 95%, 99%, or 100% identity to SEQ ID NO: 124.

In some embodiments, the disclosure provides a vector comprising a polynucleotide sequence that encodes the limbin protein, operatively linked to a modified cardiac TNNT2 promoter. Similarly stated, in some embodiments, the polynucleotide sequence operatively linked to the cardiac-specific promoter (e.g., a modified TNNT2 promoter) is EVC2, or a mutant, variant, or fragment thereof (e.g., SEQ ID NO: 125). In humans, the EVC2 gene encodes the limbin protein (e.g., SEQ ID NO: 126). While the function of limbin is unknown, it is important for normal growth and development, particularly the development of bones and teeth. In some embodiments, the polynucleotide encoding limbin shares at least 90%, 95%, 99%, or 100% identity to SEQ ID NO: 125. In some embodiments, the limbin protein shares at least 90%, 95%, 99%, or 100% identity to SEQ ID NO: 126.

In some embodiments, the disclosure provides a vector comprising a polynucleotide sequence that encodes the fibrillin-1 protein, operatively linked to a modified cardiac TNNT2 promoter. Similarly stated, in some embodiments, the polynucleotide sequence operatively linked to the cardiac-specific promoter (e.g., a modified TNNT2 promoter) is FBN1, or a mutant, variant, or fragment thereof (e.g., SEQ ID NO: 127). In humans, the FBN1 gene encodes fibrillin-1 and asprosin proteins (e.g., SEQ ID NO: 128). Fibrillin-1 is a glycoprotein that serves as a structural component of calcium-binding microfibrils, which provide force-bearing support in elastic and nonelastic connective tissue throughout the body. Asprosin is a hormone normally secreted by white adipose tissue to regulate glucose homeostasis. In some embodiments, the polynucleotide encoding fibrillin-1 shares at least 90%, 95%, 99%, or 100% identity to SEQ ID NO: 127. In some embodiments, the fibrillin-1 protein shares at least 90%, 95%, 99%, or 100% identity to SEQ ID NO: 128.

In some embodiments, the disclosure provides a vector comprising a polynucleotide sequence that encodes the neurofibromin (NF1) protein, operatively linked to a modified cardiac TNNT2 promoter. Similarly stated, in some embodiments, the polynucleotide sequence operatively linked to the cardiac-specific promoter (e.g., a modified TNNT2 promoter) is NF1, or a mutant, variant, or fragment thereof (e.g., SEQ ID NO: 129). In humans, the NF1 gene encodes the NF1 protein (e.g., SEQ ID NO: 130), which functions as a tumor suppressor and negative regulator of the Ras signaling pathway that stimulates cell growth and division. In some embodiments, the polynucleotide encoding NF1 shares at least 90%, 95%, 99%, or 100% identity to SEQ ID NO: 129. In some embodiments, the NF1 protein shares at least 90%, 95%, 99%, or 100% identity to SEQ ID NO: 130.

In some embodiments, the disclosure provides a vector comprising a polynucleotide sequence that encodes the sodium channel protein type 5 subunit alpha (SCN5A) protein, operatively linked to a modified cardiac TNNT2 promoter. Similarly stated, in some embodiments, the polynucleotide sequence operatively linked to the cardiac-specific promoter (e.g., a modified TNNT2 promoter) is SCN5A, or a mutant, variant, or fragment thereof (e.g., SEQ ID NO: 131). In humans, the SCN5A gene encodes the SCN5A protein (e.g., SEQ ID NO: 132), which is a tetrodotoxin-resistant voltage-gated sodium channel subunit. SCN5A is found primarily in cardiac muscle and is responsible for the initial upstroke of the action potential in an electrocardiogram. In some embodiments, the polynucleotide encoding SCN5A shares at least 90%, 95%, 99%, or 100% identity to SEQ ID NO: 131. In some embodiments, the SCN5A protein shares at least 90%, 95%, 99%, or 100% identity to SEQ ID NO: 132.

In some embodiments, the disclosure provides a vector comprising a polynucleotide sequence that encodes the son of sevenless homolog 1 (SOS1) protein, operatively linked to a modified cardiac TNNT2 promoter. Similarly stated, in some embodiments, the polynucleotide sequence operatively linked to the cardiac-specific promoter (e.g., a modified TNNT2 promoter) is SOS1, or a mutant, variant, or fragment thereof (e.g., SEQ ID NO: 133). In humans, the SOS1 gene encodes the SOS1 protein (e.g., SEQ ID NO: 134), which functions as a component of a trimeric complex that participates in transduction signals from Ras to Rac by promoting Rac-specific guanine nucleotide exchange factor activity. In some embodiments, the polynucleotide encoding SOS1 shares at least 90%, 95%, 99%, or 100% identity to SEQ ID NO: 133. In some embodiments, the SOS1 protein shares at least 90%, 95%, 99%, or 100% identity to SEQ ID NO: 134.

In some embodiments, the disclosure provides a vector comprising a polynucleotide sequence that encodes the natriuretic peptide receptor 1 (NPR1) protein, operatively linked to a modified cardiac TNNT2 promoter. Similarly stated, in some embodiments, the polynucleotide sequence operatively linked to the cardiac-specific promoter (e.g., a modified TNNT2 promoter) is NPR1, or a mutant, variant, or fragment thereof (e.g., SEQ ID NO: 135). The NPR1 gene in humans encodes the NPR1 protein (also referred to as GC-A) (e.g., SEQ ID NO: 136), which is a transmembrane catalytic receptor with intracellular guanylyl cyclase activity. NPR1 serves as a receptor for both atrial and brain natriuretic peptides, which are vasoactive hormones that play a key role in cardiovascular homeostasis. In some embodiments, the polynucleotide encoding NPR1 shares at least 90%, 95%, 99%, or 100% identity to SEQ ID NO: 135.

In some embodiments, the NPR1 protein shares at least 90%, 95%, 99%, or 100% identity to SEQ ID NO: 136.

In some embodiments, the disclosure provides a vector comprising a polynucleotide sequence that encodes the receptor tyrosine-protein kinase erbB-4 (ERBB4) protein, operatively linked to a modified cardiac TNNT2 promoter. Similarly stated, in some embodiments, the polynucleotide sequence operatively linked to the cardiac-specific promoter (e.g., a modified TNNT2 promoter) is ERBB4, or a mutant, variant, or fragment thereof (e.g., SEQ ID NO: 137). The ERBB4 gene in humans encodes the ERBB4 protein in humans (e.g., SEQ ID NO: 138), which is a transmembrane receptor in the epidermal growth factor family. Signaling through the ERBB4 receptor induces a variety of cellular responses, including mitogenesis and differentiation. In some embodiments, the polynucleotide encoding ERBB4 shares at least 90%, 95%, 99%, or 100% identity to SEQ ID NO: 137. In some embodiments, the ERBB4 protein shares at least 90%, 95%, 99%, or 100% identity to SEQ ID NO: 138.

In some embodiments, the disclosure provides a vector comprising a polynucleotide sequence that encodes vasoactive intestinal peptide (VIP), operatively linked to a modified TNNT2 promoter. Similarly stated, in some embodiments, the polynucleotide sequence operatively linked to the cardiac-specific promoter (e.g., a modified TNNT2 promoter) is VIP, or a mutant, variant, or fragment thereof (e.g., SEQ ID NO: 139). In humans, the VIP gene encodes the vasoactive intestinal peptide (e.g., SEQ ID NO: 140), which functions as a neuromodulator and neurotransmitter. VIP is a potent vasodilator, regulates smooth muscle activity, epithelial cell secretion and blood flow in the gastrointestinal tract. In some embodiments, the polynucleotide encoding VIP shares at least 90%, 95%, 99%, or 100% identity to SEQ ID NO: 139. In some embodiments, the VIP protein shares at least 90%, 95%, 99%, or 100% identity to SEQ ID NO: 140.

In some embodiments, the disclosure provides a vector comprising a polynucleotide sequence that encodes the beta-myosin heavy chain (MyHC-β), operatively linked to a modified cardiac TNNT2 promoter. Similarly stated, in some embodiments, the polynucleotide sequence operatively linked to the cardiac-specific promoter (e.g., a modified TNNT2 promoter) is MYH7, or a mutant, variant, or fragment thereof (e.g., SEQ ID NO: 141). In humans, the MYH7 gene encodes the MyHC-β protein (e.g., SEQ ID NO: 142), which is a hexameric, asymmetric motor forming the majority of the thick filaments in cardiac muscle. The enzymatic activity of the ATPase in the myosin head hydrolyzes ATP, fueling the process of shortening sarcomeres in order to generate intraventricular pressure and power. In some embodiments, the polynucleotide encoding MyHC-β shares at least 90%, 95%, 99%, or 100% identity to SEQ ID NO: 141. In some embodiments, the MyHC-β protein shares at least 90%, 95%, 99%, or 100% identity to SEQ ID NO: 142.

III. Vectors

In some embodiments, the disclosure provides vectors for the treatment or prevention of heart disease. In particular, the vectors described herein comprise a cardiac-specific promoter operatively linked to a polynucleotide that encodes a therapeutic protein, wherein expression of the therapeutic protein treats a subject in need thereof (e.g., a subject having cardiomyopathy). For example, in some embodiments, the vector is an AAV-based vector comprising the cardiac TNNT2 promoter operatively linked to a polynucleotide that encodes the MYBPC3 protein for the treatment or prevention of cardiomyopathy.

In some embodiments, the vector comprises, in addition to the cardiac-specific promoters (e.g., a modified cardiac troponin T promoter) and therapeutic gene products (e.g., MYBPC3 protein) described herein, a marker gene that facilitates identification or selection of cells that have been transfected, transduced or infected. Examples of marker genes include, but are not limited to, genes encoding fluorescent proteins, e.g., enhanced green fluorescent protein, Ds-Red (DsRed: *Discosoma* sp. red fluorescent protein (RFP); Bevis et al. (2002) Nat. Biotechnol. 20(11):83-87), yellow fluorescent protein, mCherry, and cyanofluorescent protein; and genes encoding proteins conferring resistance to a selection agent, e.g., a neomycin resistance gene, a puromycin resistance gene, a blasticidin resistance gene, and the like.

In some embodiments, the vector comprises a polynucleotide sequence having a size of at most about 4.0 kilobases, at most about 4.5 kilobases, at most about 5 kilobases, at most about 5.1 kilobases, at most about 5.2 kilobases, at most about 5.3 kilobases, at most about 5.4 kilobases, or at most about 5.5 kilobases. In some embodiments, the vector comprises a polynucleotide sequence having a size of at most about 4.5 kilobases. In some embodiments, the vector comprises a polynucleotide sequence having a size of at most about 5 kilobases. In some embodiments, the vector comprises a polynucleotide sequence having a size of at most about 5.5 kilobases. In some embodiments, the vector comprises a polynucleotide sequence having a size of at most about 6 kilobases.

Methods of introducing polynucleotides into a host cell are known in the art, and any known method can be used to introduce the polynucleotides described herein into a cell. Suitable methods include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery, microfluidics delivery methods, and the like.

A. Non-Viral Vectors

In some embodiments, the polynucleotides described herein are delivered to a cell in a non-viral vector, such as a transposon, a nanoparticle (e.g., a lipid nanoparticle), a liposome, an exosome, an attenuated bacterium, or a virus-like particle. In some embodiments, the non-viral vector is a mammalian virus-like particle. For example, mammalian virus-like particle can be generated (e.g., by purification of the "empty" mammalian virus-like particle followed by ex vivo assembly of the mammalian virus-like particle with the desired cargo). The non-viral vector can also be engineered to incorporate targeting ligands to alter target tissue specificity.

B. Viral Vectors

In some embodiments, the vector is a viral vector. In some embodiments, the viral vector is a retroviral vector, e.g., a lentiviral vector. As used herein, the term "retrovirus" or "retroviral" refers an RNA virus that reverse transcribes its genomic RNA into a linear double-stranded DNA copy and subsequently covalently integrates its genomic DNA into a host genome. Retrovirus vectors are a common tool for gene delivery (Miller, Nature. 357: 455-460 (2000)). Once the virus is integrated into the host genome, it is referred to as a "provirus." The provirus serves as a template for RNA polymerase II and directs the expression of RNA molecules encoded by the virus. In some embodiments, a retroviral vector is altered so that it does not integrate into the host cell genome.

Illustrative retroviruses (family Retroviridae) include, but are not limited to: (1) genus gammaretrovirus, such as, Moloney murine leukemia virus (M-MuLV), Moloney murine sarcoma virus (MoMSV), murine mammary tumor virus (MuMTV), gibbon ape leukemia virus (GaLV), and feline leukemia virus (FLV), (2) genus spumavirus, such as, simian foamy virus, (3) genus lentivirus, such as, human immunodeficiency virus-1 and simian immunodeficiency virus.

As used herein, the term "lentiviral" or "lentivirus" refers to a group (or genus) of complex retroviruses. Illustrative lentiviruses include, but are not limited to: HIV (human immunodeficiency virus; including HIV type 1, and HIV type 2; visna-maedi virus (VMV) virus; the caprine arthritis-encephalitis virus (CAEV); equine infectious anemia virus (EIAV); feline immunodeficiency virus (FIV); bovine immune deficiency virus (BIV); and simian immunodeficiency virus (SIV).

In some embodiments, the viral vector is an adenoviral vector. The genetic organization of adenovirus includes an approximate 36 kb, linear, double-stranded DNA virus, which allows substitution of large pieces of adenoviral DNA with foreign sequences up to 7 kb (Grunhaus et al., *Seminar in Virology* 200(2):535-546, 1992)).

In some embodiments, the viral vector is an adeno-associated viral (AVV) vector, such as an AAV vector selected from the group consisting of serotype 1, 2, 3, 4, 5, 6, 7, 8, 9, and 10 or chimeric AAV derived thereof.

In some embodiments, the AAV expression vector is pseudotyped to enhance targeting. A pseudotyping strategy can promote gene transfer and sustain expression in a target cell type. For example, the AAV2 genome can be packaged into the capsid of another AAV serotype such as AAV5, AAV7, or AAV8, producing pseudotyped vectors such as AAV2/5, AAV2/7, and AAV2/8 respectively, as described in Balaji et al. *J Surg Res. September;* 184(1): 691-698 (2013). In some embodiments, an AAV9 may be used to target expression in myofibroblast-like lineages, as described in Piras et al. *Gene Therapy* 23:469-478 (2016). In some embodiments, AAV1, AAV6, or AAV9 is used, and in some embodiments, the AAV is engineered, as described in Asokari et al. *Hum Gene Ther. November;* 24(11): 906-913 (2013); Pozsgai et al. Mol Ther. April 5; 25(4): 855-869 (2017); Kotterman, M. A. and D. V. Schaffer Engineering Adeno-Associated Viruses for Clinical Gene Therapy. *Nature Reviews Genetics,* 15:445-451 (2014); and US20160340393A1 to Schaffer et al. In some embodiments, the viral vector is AAV engineered to increase target cell infectivity as described in US20180066285A1.

C. Regulatory Elements

In some embodiments, the disclosure provides a vector comprising one or more regulatory elements operatively linked to a polynucleotide encoding a therapeutic protein or nucleic acid. In some embodiments, the regulatory element is a cardiac-specific promoter (e.g., a modified TNNT2 promoter) that is operatively linked to a therapeutic protein or nucleic acid for the treatment of heart disease.

As used herein, the term "regulatory element" refers those non-translated regions of the vector (e.g., origin of replication, selection cassettes, promoters, enhancers, translation initiation signals (Shine Dalgarno sequence or Kozak sequence) introns, a polyadenylation sequence, 5' and 3' untranslated regions) which interact with host cellular proteins to carry out transcription and translation. Such elements may vary in their strength and specificity. The transcriptional regulatory element may be functional in either a eukaryotic cell (e.g., a mammalian cell) or a prokaryotic cell (e.g., bacterial or archaeal cell). In some embodiments, a polynucleotide sequence encoding the therapeutic gene products (e.g., a therapeutic protein or nucleic acid) described herein is operably linked to multiple control elements that allow expression of the polynucleotide in both prokaryotic and eukaryotic cells.

As used herein, the term "transcription start site" or "TSS" refers to the first base pair transcribed by an RNA polymerase when the RNA polymerase initiates transcription. A TSS is different from the start codon (canonically, ATG), which must be downstream of the TSS in the transcribed region of the polynucleotide. The location of a transcription start site can be determined experimentally or by prediction using any of various prediction algorithms. Annotated TSSs are available from the Eukaryotic Promoter Database and the UCSC Genome Browser. Multiple TSSs for TNNT2 are identified in the UCSC Genome Browser.

As used herein, the TSS for TNNT2 is defined to be the sequence identified by the C at the 5' end of the motif identified by dbTSS: CTCCATC.

The term "modified cardiac TNNT2 promoter" as used herein refers to a promoter that comprises a polynucleotide sequence of at least 200 base pairs that comprises one or more continuous or discontinuous polynucleotide segments each sharing 70%, 80%, 90%, 95%, 96%, 97%, 98%, 99%, or 100% identity to a corresponding segment of the TNNT2p-600 segment provided in Table 1 as SEQ ID NO: 1. As it is a "promoter," a modified cardiac TNNT2 promoter must be capable of promoting initiation of transcription by an RNA polymerase in a host or target cell at or near a TSS within the promoter (i.e. at or near the TTS of TNNT2 as defined herein) or, if the endogenous TSS of TNNT2 is not present in the modified cardiac TNNT2 promoter then at a heterologous TSS at most 100 base pairs downstream (3' on the sense strand) to the downstream (3') end of the modified cardiac TNNT2 promoter. Similarly stated, a modified cardiac TNNT2 promoter may comprise only sequences upstream of the TSS of TNNT2 or more comprise the TSS of TNNT2.

The length of a promoter (e.g., a modified cardiac TNNT2 promoter), a promoter "having" so many base pairs, as used herein, is defined according to the number of base pairs in the polynucleotide sequence of the promoter from its 5' end to its 3' end, inclusive of the endpoints, and inclusive of any intervening sequences that do not align to a reference promoter sequence (e.g., the endogenous cardiac TNNT2 promoter of a human or other organism). The 5' end and the 3' end of the promoter are defined as the last base pair in either direction to match a corresponding sequence in a reference promoter sequence when the sequence are aligned by the BLAST algorithm or the equivalent. Thus, the length of a promoter in a vector can be determined by searching a nucleotide database containing a genome of a reference organism using the polynucleotide sequence of the vector and identifying one or more aligned regions that encompass or are within about 1-5 kb of an endogenous gene, or by aligning the vector to a predetermined reference promoter. If the promoter aligns to the reference genome or reference promoter sequence as a continuous segment, then the length of promoter is the length alignment reported (the 3' end position minus the 5' end position, +1 unless the TSS is included). If the promoter aligns in multiple segments (e.g., 2, 3, 4, or 5 segments), then the length of the promoter can be calculated by the 3' end position of the 3'-most segment of the reference genome or reference promoter sequence, minus the 5' end position of the 5'-most segment of reference genome or reference promoter sequence, plus 1 unless the TSS is included (such that the calculated length includes both end points). For example, the length of a promoter that extends from a base pair 100 bp before the TSS (−100 bp) to 5 bp before the TSS (−5 bp) is −5−(−100)+1=100−5+1=96 bp. The TSS is numbered +1 bp. Therefore, the length of a promoter that extends from a base pair 100 bp before the TSS (−100 bp) to 5 bp after the TSS (+5 bp) is +5−(−100) =100+5=105 bp.

The term "enhancer" refers to a segment of DNA which contains sequences capable of providing enhanced transcription and in some instances can function independent of their orientation relative to another control sequence. An enhancer can function cooperatively or additively with promoters and/or other enhancer elements. An enhancer may overlap with a promoter or be upstream or downstream of the promoter. In some embodiments, the modified cardiac TNNT2 promoter comprises one or more enhancers. In some embodiments, the modified cardiac TNNT2 promoter comprises no enhancer.

In addition to or instead of a modified cardiac TNNT2 promoter, some embodiments employ other eukaryotic promoters, including but not limited to: cytomegalovirus (CMV) immediate early, herpes simplex virus (HSV) thymidine kinase, a viral simian virus 40 (SV40) (e.g., early and late SV40), a spleen focus forming virus (SFFV) promoter, long terminal repeats (LTRs) from retrovirus (e.g., a Moloney murine leukemia virus (MoMLV) LTR promoter or a Rous sarcoma virus (RSV) LTR), a herpes simplex virus (HSV) (thymidine kinase) promoter, H5, P7.5, and P11 promoters from vaccinia virus, an elongation factor 1-alpha (EF1α) promoter, early growth response 1 (EGR1) promoter, a ferritin H (FerH) promoter, a ferritin L (FerL) promoter, a Glyceraldehyde 3-phosphate dehydrogenase (GAPDH) promoter, a eukaryotic translation initiation factor 4A1 (EIF4A1) promoter, a heat shock 70 kDa protein 5 (HSPA5) promoter, a heat shock protein 90 kDa beta, member 1 (HSP90B1) promoter, a heat shock protein 70 kDa (HSP70) promoter, a β-kinesin ((3-KIN) promoter, the human ROSA 26 locus (Irions et al., *Nature Biotechnology* 25, 1477-1482 (2007)), a Ubiquitin C (UBC) promoter, a phosphoglycerate kinase-1 (PGK) promoter, a cytomegalovirus enhancer/chicken β-actin (CAG) promoter, a β-actin promoter and a myeloproliferative sarcoma virus enhancer, negative control region deleted, d1587rev primer-binding site substituted (MND) promoter, and mouse metallothionein-1. The vector may also contain a ribosome binding site for translation initiation and a transcription terminator. The vector may also include polynucleotide sequences for amplifying expression. The vector may also include polynucleotide sequences encoding protein tags (e.g., 6×His tag, hemagglutinin tag, green fluorescent protein, etc.) that are fused to the site-directed modifying polypeptide, thus resulting in a chimeric polypeptide.

In some embodiments, the promoters of the disclosure are tissue-specific. The term "tissue-specific promoter" means a polynucleotide sequence that serves as a promoter, i.e., regulates expression of a selected polynucleotide sequence operably linked to the promoter, and which affects expression of the selected polynucleotide sequence in specific cells of a tissue, such as myocytes or myocardial cells. In some embodiments, the tissue-specific promoter is a cardiac-specific promoter. In some embodiments, the cardiac-specific promoter is TNNT2 or a modified TNNT2 promoter. A tissue-specific promoter causes expression of an operatively linked polynucleotide, or a gene product encoded by that polynucleotide, at 5×, 10×, 20×, 25× or greater levels in the tissue of interest than in a reference tissue.

In some embodiments, the vectors described herein comprise a transcription termination signal. Elements directing the efficient termination and polyadenylation of the heterologous nucleic acid transcripts increases heterologous gene expression. Transcription termination signals are generally found downstream of the polyadenylation signal. In some embodiments, vectors comprise a polyadenylation sequence 3' of a polynucleotide encoding a polypeptide to be expressed. The term "polyA site" or "polyA sequence" as used herein denotes a DNA sequence which directs both the termination and polyadenylation of the nascent RNA transcript by RNA polymerase II. Polyadenylation sequences can promote mRNA stability by addition of a polyA tail to the 3' end of the coding sequence and thus, contribute to increased translational efficiency. Cleavage and polyadenylation is directed by a poly(A) sequence in the RNA. The core poly(A) sequence for mammalian pre-mRNAs has two recognition elements flanking a cleavage-polyadenylation site. Typically, an almost invariant AAUAAA hexamer lies 20-50 nucleotides upstream of a more variable element rich in U or GU residues. Cleavage of the nascent transcript occurs between these two elements and is coupled to the addition of up to 250 adenosines to the 5' cleavage product. In particular embodiments, the core poly(A) sequence is an ideal polyA sequence (e.g., AATAAA, ATTAAA, AGTAAA). In particular embodiments, the poly(A) sequence is an SV40 polyA sequence, a bovine growth hormone polyA sequence (BGHpA), a rabbit β-globin polyA sequence (rβgpA), variants thereof, or another suitable heterologous or endogenous polyA sequence known in the art.

Figure 2A:
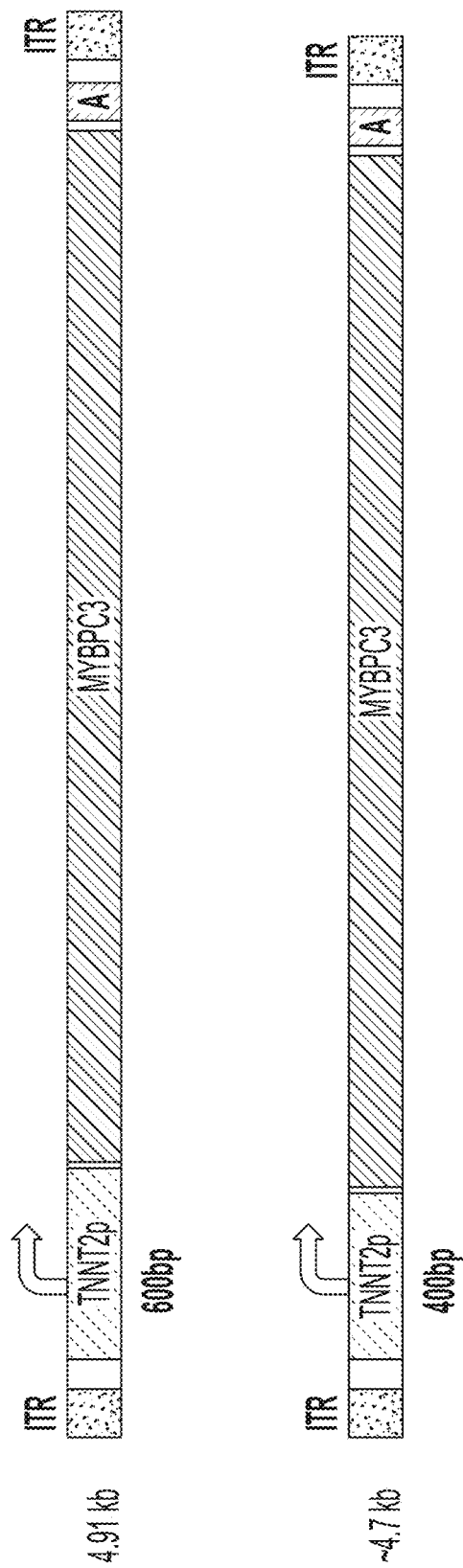
FIG. 2A shows a schematic of the original and altered versions of a viral genome comprising the cardiac-specific troponin (TNNT2) promoter and myosin binding protein C (MYBPC3) transgene.

IV. Recombinant Adeno-Associated Virus (rAAV) Viral Genome, Expression Cassette, and rAAV Virions The disclosure provides an expression cassette comprising a polynucleotide encoding a transgene, e.g. a sequence encoding a MYBPC3 polypeptide, or functional variant thereof. The transgene polynucleotide sequence in an expression cassette can be, for example, an open reading frame encoding a protein. The expression cassette may comprise, optionally, a promoter operatively linked to the transgene, optionally an intron region, optionally a polyadenylation (poly(A)) signal, optionally a woodchuck hepatitis virus post-transcriptional element (WPRE), and optionally a transcription termination signal. The expression cassette may be flanked by one or more inverted terminal repeats (ITRs). An expression cassette flanked by one or more ITRs is herein referred to as a "viral genome." The ITRs in an expression cassette serve as markers used for viral packaging of the expression cassette (Clark et al. Hum Gene Ther. 6:1329-41 (1995)). Illustrative and non-limiting embodiments of viral genomes of the disclosure are shown in FIG. 1A, FIG. 1C, and FIG. 2A. The polynucleotide encoding the expression cassette provides the function of expressing the transgene within a host cell. The expression cassette can be integrated into the host cell genome by, for example, infecting the host cell with an rAAV virion comprising capsid protein and a viral genome comprising an expression cassette.

The promoter sequence of the expression cassette, when present, controls expression of the polynucleotide encoding the transgene, e.g. a sequence encoding MYBPC3 or functional variant thereof. Various promoters can be used. The promoter may be cell-type specific. Constitutive promoters are used in expression cassettes and can be, for example, the cytomegalovirus enhancer fused to the chicken β-actin promoter (CAG), simian virus 40 (SV40) promoter, and the herpes simplex virus thymidine kinase (HSV-TK) promoter (Damdindorj et al. PLoS One. 9:e106472 (2014)). Other cell-type specific promoters may also be used. Cardiac cell specific promoters can be, for example, the MLC2v promoter (Phillips et al. Hypertension. 39:651-5 (2002)) and the cardiac Troponin-T (cTnT) promoter (Konkalmatt et al. Circ Cardiovasc Imaging. 6:478-486 (2013)).

In some aspects, the disclosure provides promoters have been optimized for cardiac cell-specific expression and length to accommodate transgenes of specified size. In one embodiment, the promoter of an rAAV vector genome described herein is a polynucleotide having between 300 bp and 500 bp.

Exemplary expression cassette and viral genome sequences of the disclosure can be found in Table 5. In some embodiments, the expression cassette comprises a polynucleotide sequence that shares at least 90%, 95%, 96%, 97%, 98%, 99%, or 100% identity to SEQ ID NO: 95, SEQ ID NO: 99, or SEQ ID NO: 101. In some embodiments, the viral genome comprises a polynucleotide sequence that shares at least 90%, 95%, 96%, 97%, 98%, 99%, or 100% identity to SEQ ID NO: 98, SEQ ID NO: 100, or SEQ ID NO: 102. In another embodiment, an expression cassette can be segmented according to the polynucleotide regions flanking the transgene. The polynucleotide sequence spanning the 5' end of the cassette to the 5' end of the transgene is herein referred to as the 5' segment of the expression cassette. The polynucleotide sequence spanning the 3' end of the transgene to the 3' end of the expression cassette is herein referred to as the 3' segment of the expression cassette. In one embodiment, the 5' segment of the expression cassette comprises a polynucleotide sequence that shares at least 90%, 95%, 96%, 97%, 98%, 99%, or 100% identity to SEQ ID NO: 93. In one embodiment, the 3' segment of the expression cassette comprises a polynucleotide sequence that shares at least 90%, 95%, 96%, 97%, 98%, 99%, or 100% identity to SEQ ID NO: 94.

The ability to express large transgenes delivered by rAAV vectors or rAAV virions is limited. rAAV vector genome sizes have a maximum sequence length of about 5 kb, thus providing a limit for the length of all elements required in an expression cassette including regulatory elements, e.g. promoter, and a transgene, e.g. MYBPC3. rAAV vector genomes exceeding 5 kb result in vector genome truncation during rAAV virion packaging and reduce or ablate transgene expression (Wu et al. Mol Ther. 18:80-86 (2010)). In some embodiments, the present disclosure provides rAAV vector genomes that are optimized for carrying large transgenes. Elements of the vector genome have been reduced in length in order to accommodate a larger transgene. In one embodiment, the 5' segment and 3' segment of an expression cassette together comprise at most 0.8 kbp or at most 0.9 kbp. In another embodiment, the 5' ITR, the 5' segment, the 3' segment, and 3' ITR together comprise 1.2 kbp or at most comprise 1.3 kbp. In one embodiment, the 5' segment comprises at most 500 bp or at most 480 bp. In one embodiment, the 3' segment comprises at most 200 bp or at most 150 bp. In another embodiment, the vector genome comprises at most 4.7 kbp. 4.8 kbp, 4.9 kbp, or 5.0 kbp. In some embodiments, the polynucleotide encoding the gene product comprises between 3 kb and 11 kb, between 3 kbp and 5 kbp, between 3.5 kbp and 4.5 kbp, or between 3.7 kbp and 4 kbp. In some embodiments, the polynucleotide encoding the gene product comprises 3.7 kbp to 3.9 kbp. In some embodiments, the polynucleotide encoding the gene product comprises 3.8 kbp.

TABLE 5

Illustrative expression cassette and viral genomes

| Name | DNA Sequence | SEQ ID NO. |
| --- | --- | --- |
| viral genome (600 bp promoter) | Ctgcgcgctcgctcgctcactgaggccgcccgggcaaagcccgggcgtcgggcgacc tttggtcgcccggcctcagtgagcgagcgagcgcgcagagagggagtggccaactcc atcactaggggttccttgtagttaatgattaacccgccatgctacttatctacgtag ccatgctctaggaagatcggaattcgcccttaagtcatggagaagacccaccttgca gatgtcctcactggggctggcagagccggcaacctgcccaaggctgctcagtccatt aggagccagtagcctggaagatgtctttacccccagcatcagttcaagtggagcagc acataactcttgccctctgccttccaagattctggtgctgagacttatggagtgtct tggaggttgccttctgccccccaaccctgctcccagctggccctcccaggcctgggt tgctggcctctgctttatcaggattctcaagagggacagctggtttatgttgcatga ctgttccctgcatatctgctctggttttaaatagcttatctgagcagctggaggacc acatgggcttatatggcgtggggtacatgttcctgtagccttgtccctggcacctgc caaaatagcagccaacaccccccacccccaccgccatcccccctgccccacccgtccc ctgtcgcacattcctccctccgcagggctggctcaccaggcccagcccacatgcct gcttaaagccctctccatcctctgcctcaccagtccccgctgagactgagcagacg cctccagccaccaagcttaataaaagatctttattttcattagatctgtgtgttggt ttttgtgtgctggggactcgagttaagggcgaattcccgataaggatcttcctaga gcatggctacgtagataagtagcatggcgggttaatcattaactacaaggaaccct agtgatggagttggccactccctctctgcgcgctcgctcgctcactgaggccgggcg accaaaggtcgcccgacgcccgggctttgcccgggcggcctcagtgagcgagcgagc gcgcag | 98 |
| expression cassette (600 bp promoter) | Tgtagttaatgattaacccgccatgctacttatctacgtagccatgctctaggaaga tcggaattcgcccttaagtcatggagaagacccaccttgcagatgtcctcactggg ctggcagagccggcaacctgcccaaggctgctcagtccattaggagccagtagcctg gaagatgtctttacccccagcatcagttcaagtggagcagcacataactcttgccct ctgccttccaagattctggtgctgagacttatggagtgtcttggaggttgccttctg ccccccaaccctgctcccagctggccctcccaggcctgggttgctggcctctgcttt atcaggattctcaagagggacagctggtttatgttgcatgactgttccctgcatatc tgctctggttttaaatagcttatctgagcagctggaggaccacatgggcttatatgg cgtggggtacatgttcctgtagccttgtccctggcacctgccaaaatagcagccaac accccccacccccaccgccatcccccctgccccacccgtccctgtcgcacattcctc cctccgcagggctggctcaccaggcccagcccacatgcctgcttaaagccctctcc atcctctgcctcaccagtccccgctgagactgagcagacgcctccagccaccaagc ttaataaaagatctttattttcattagatctgtgtgttggtttttttgtgtgctgggg actcgagttaagggcgaattcccgataaggatcttcctagagcatggctacgtagat aagtagcatggcgggttaatcattaactacaa | 99 |
| viral genome (400 bp promoter) | Ctgcgcgctcgctcgctcactgaggccgcccgggcaaagcccgggcgtcgggcgacc tttggtcgcccggcctcagtgagcgagcgagcgcgcagagagggagtggccaactcc atcactaggggttccttgtagttaatgattaacccgccatgctacttatctacgtag ccatgctctaggaagatcggaattcgcccttaagttgccttctgccccccaaccctg ctcccagctggccctccaggcctgggttgctggcctctgctttatcaggattctca agagggacagctggtttatgttgcatgactgttccctgcatatctgctctggtttta aatagcttatctgagcagctggaggaccacatgggcttatatggcgtggggtacatg ttcctgtagccttgtccctggcacctgccaaaatagcagccaacaccccccacccc accgccatcccccctgccccacccgtccctgtcgcacattcctccctccgcagggct ggctcaccaggcccagcccacatgcctgcttaaagccctctccatcctctgcctca ccagtccccgctgagactgagcagacgcctccagccaccaagcttaataaaagatc tttattttcattagatctgtgtgttggtttttttgtgtgctggggactcgagttaagg gcgaattcccgataaggatcttcctagagcatggctacgtagataagtagcatggcg ggttaatcattaactacaaggaaccctagtgatggagttggccactccctctctgc gcgctcgctcgctcactgaggccgggcgaccaaaggtcgcccgacgcccgggctttg cccgggcggcctcagtgagcgagcgagcgcgcag | 100 |
| expression cassette (400 bp promoter) | Tgtagttaatgattaacccgccatgctacttatctacgtagccatgctctaggaaga tcggaattcgcccttaagttgccttctgccccccaaccctgctcccagctggccctc ccaggcctgggttgctggcctctgctttatcaggattctcaagagggacagctggtt tatgttgcatgactgttccctgcatatctgctctggttttaaatagcttatctgagc agctggaggaccacatgggcttatatggcgtggggtacatgttcctgtagccttgtc cctggcacctgccaaaatagcagccaacaccccccacccccaccgccatcccctgc cccacccgtccctgtcgcacattcctccctccgcagggctggctcaccaggcccca gcccacatgcctgcttaaagccctctccatcctctgcctcaccagtccccgctgag actgagcagacgcctccagccaccaagcttaataaaagatctttattttcattagat ctgtgtgttggtttttttgtgtgctggggactcgagttaagggcgaattcccgataag gatcttcctagagcatggctacgtagataagtagcatggcgggttaatcattaacta ca | 101 |
| viral genome + MYBPC3 transgene (400 bp promoter) | ctgcgcgctcgctcgctcactgaggccgcccgggcaaagcccgggcgtcgggcgacc tttggtcgcccggcctcagtgagcgagcgagcgcgcagagagggagtggccaactcc atcactaggggttccttgtagttaatgattaacccgccatgctacttatctacgtag ccatgctctaggaagatcggaattcgcccttaagttgccttctgccccccaaccctg ctcccagctggccctccaggcctgggttgctggcctctgctttatcaggattctca agagggacagctggtttatgttgcatgactgttccctgcatatctgctctggtttta aatagcttatctgagcagctggaggaccacatgggcttatatggcgtggggtacatg ttcctgtagccttgtccctggcacctgccaaaatagcagccaacaccccccacccc | 102 |

TABLE 5-continued

Illustrative expression cassette and viral genomes

| Name | DNA Sequence | SEQ ID NO. |
|---|---|---|
|  | accgccatcccctgccccacccgtccctgtcgcacattcctccctccgcagggct ggctcaccaggccccagcccacatgcctgcttaaagccctctccatcctctgcctca cccagtcccgctgagactgagcagacgcctccagccaccatgcctgagccggggaa gaagccagtctcagcttttagcaagaagccacggtcagtggaagtggccgcaggcag ccctgccgtgttcgaggccgagacagagcgggcaggagtgaaggtgcgctggcagcg cggaggcagtgacatcagcgccagcaacaagtacggcctggccacagagggcacacg gcatacgctgacagtgcgggaagtgggccctgccgaccagggatcttacgcagtcat tgctggctcctccaaggtcaagttcgacctcaaggtcataggagcagagaaggcaga gcccatgctggcccctgcccctgccctgctgaggcactggagcccctggagaagc cccgccccagccgctgagctgggagaaagtgccccaagtcccaaagggtcaagctc agcagctctcaatggtcctacccctggagccccgatgaccccattggcctcttcgt gatgcggccacaggatggcgaggtgaccgtgggtggcagcatcaccttctcagcccg cgtggccggcgccagcctcctgaagccgcctgtggtcaagtggttcaagggcaaatg ggtggacctgagcagcaaggtgggccagcacctgcagctgcacgacagctacgaccg cgccagcaaggtctatctgttcgagctgcacatcaccgatgcccagcctgccttcac tggcagctaccgctgtgaggtgtccaccaaggacaaatttgactgctccaacttcaa tctcactgtccacgaggccatgggcaccggagacctggacctcctatcagccttccg ccgcacgagcctggctggaggtggtcggcggatcagtgatagccatgaggacactgg gattctggacttcagctcactgctgaaaaagagagacagtttccggaccccgaggga ctcgaagctggaggcaccagcagaggaggacgtgtgggagatcctacggcaggcacc cccatctgagtacgagcgcatcgccttccagtacggcgtcactgacctgcgcggcat gctaaagaggctcaagggcatgaggcgcgatgagaagaagagcacagcctttcagaa gaagctggagccggcctaccaggtgagcaaaggccacaagatccggctgaccgtgga actggctgaccatgacgctgaggtcaaatggctcaagaatggccaggagatccagat gagcggcagcaagtacatctttgagtccatccggtgccaagcgtaccctgaccatcag ccagtgctcattggcggacgacgcagcctaccagtgcgtggtgggtggcgagaagtg tagcacggagctctttgtgaaagaccccctgtgctcatcacgcgcccccttggagga ccagctggtgatggtggggcagcgggtggagtttgagtgtgaagtatcggaggaggg ggcgcaagtcaaatggctgaaggacggggtggagctgacccgggaggagaccttcaa ataccggttcaagaaggacgggcagagacaccacctgatcatcaacgaggccatgct ggaggacgcggggcactatgcactgtgcactagcgggggccaggcgctggctgagct cattgtgcaggaaaagaagctggaggtgtaccagagcatcgcagacctgatggtggg cgcaaaggaccaggcggtgtttcaaatgtgaggtctcagatggagaatgttcgggtgt gtggctgaagaatgggaaggagctggtgcccgacagccgcataaaggtgtcccacat cgggcgggtccacaaactgaccattgacgacgtcacacctgccgacgaggctgacta cagctttgtgcccgagggcttcgcctgcaacctgtcagccaagctccacttcatgga ggtcaagattgacttcgtacccaggcaggaacctcccaagatccacctggactgcc aggccgcataccagacaccattgtggttgtagctggaaataagctacgtctggacgt ccctatctctggggaccccgctcccactgtgatctggcagaaggctatcacgcaggg gaataagggcccagccaggccagccccagatgccccagaggacacaggtgacagcga tgagtgggtgtttgacaagaagctgctgtgtgagaccgagggccgggtccgcgtgga gaccaccaaggaccgcagcatcttcacggtcgaggggggcagagaaggaagatgaggg cgtctacacggtcacagtgaagaaccctgtgggcgaggaccaggtcaacctcacagt caaggtcatcgacgtgccagacgcacctgcggccccaagatcagcaacgtgggaga ggactcctgcacagtacagtgggagccgcctgcctacgatggcgggcagcccatcct gggctacatcctggagcgcaagaagaagaagagctaccggtggatgcggctgaactt cgacctgattcaggagctgagtcatgaagcgcggcgcatgatcgagggcgtggtgta cgagatgcgcgtctacgcggtcaacgccatcggcatgtccaggcccagccctgcctc ccagcccttcatgcctatcggtcccccccagcgaacccaccccaacctggcagtagagga cgtctctgacaccacggtctccctcaagtggcggccccccagagcgcgtgggagcagg aggcctggatggctacagcgtggagtactgcccagagggctgctcagagtgggtggc tgccctgcagggggctgacagagcacacatcgatactggtgaaggacctgcccacggg ggcccggctgcttttccgagtgcgggcacacaatatggcagggcctggagcccctgt taccaccacggagccggtgacagtgcaggagatcctgcaacggccacggcttcagct gcccaggcacctgcgccagaccattcagaagaaggtcggggagcctgtgaaccttct catcccttccagggcaagccccgcctcaggtgacctggaccaaagaggggcagcc cctggcaggcgaggaggtgagcatccgcaacagcccacagacaccatcctgttcat ccgggccgctcgccgcgtgcattcaggcacttaccaggtgacggtgcgcattgagaa catggaggacaaggccacgctggtgctgcaggttgttgacaagccaagtcctccccca ggatctccgggtgactgacgcctggggtcttaatgtggctctggagtggaagccacc ccaggatgtcggcaacacggaactctgggggtacacagtcagaaagccgacaagaa gaccatggagtggttcaccgtcttggagcattaccgccgcacccactgcgtggtgcc agagctcatcattggcaatggctactacttccgcgtcttcagccagaatatggttgg ctttagtgacagagcggccaccaccaaggagcccgtctttatccccagaccaggcat cacctatgagccacccaactataagggcctggacttctccgaggccccaagcttcac ccagcccctggtgaaccgctcggtcatcgcgggctacatgctctatgctctgctgtgc tgtccggggtagccccaagcccaagatttcctggttcaagaatggcctggacctggg agaagacgcccgcttccgcatgttcagcaagcagggagtgttgactctggagattag aaagccctgccccttttgacggggcatctatgtctgcagggccaccaacttacaggg cgaggcacggtgtgagtgccgcctggaggtgcgagtgcctcagtaaagctttaataaa agatctttatttttcattagatctgtgtgttggttttttgtgtgctggggactcgagt taagggcgaattcccgataaggatcttcctagagcatggctacgtagataagtagca tggcgggttaatcattaactacaaggaaccccctagtgatggagttggccactccctc tctgcgcgctcgctcgctcactgaggccgggcgaccaaaggtcgcccgacgcccggg cttttgcccgggcggcctcagtgagcgagcgagcgcgcag | |

TABLE 5-continued

Illustrative expression cassette and viral genomes

| Name | DNA Sequence | SEQ ID NO. |
|---|---|---|
| expression cassette + MYBPC3 transgene (400 bp promoter) | tgtagttaatgattaacccgccatgctacttatctacgtagccatgctctaggaaga tcggaattcgcccttaagttgccttctgcccccaaccctgctcccagctggccctc ccaggcctgggttgctggcctctgctttatcaggattctcaagagggacagctggtt tatgttgcatgactgttccctgcatatctgctctggttttaaatagcttatctgagc agctggaggaccacatgggcttatatggcgtggggtacatgttcctgtagccttgtc cctggcacctgccaaaatagcagccaacaccccaccccaccgccatcccctgc cccaccgtcccctgtcgcacattcctccctccgcagggctggctcaccaggcccca gcccacatgcctgcttaaagccctctccatcctctgcctcacccagtccccgctgag actgagcagacgcctccagccaccatgcctgagccggggaagaagccagtctcagct tttagcaagaagccacggtcagtggaagtggccgcaggcagccctgccgtgttcgag gccgagacagagcgggcaggagtgaaggtgcgctggcagcgcggaggcagtgacatc agcgccagcaacaagtacggcctggccacagagggcacacggcatacgctgacagtg cgggaagtgggccctgccgaccagggatcttacgcagtcattgctggctcctccaag gtcaagttcgacctcaaggtcatagaggcagagaaggcagagcccatgctggcccct gccccctgccccctgctgaggccactggagccctgagaagcccccggcccagccgct gagctgggagaaagtgcccaagtcccaaagggtcaagctcagcagctctcaatggt cctaccctggagccccgatgaccccattggcctcttcgtgatgcggcacacaggat ggcgaggtgaccgtgggtggcagcatcaccttctcagcccgcgtggccggcgccagc ctcctgaagccgcctgtggtcaagtggttcaagggcaaatgggtggacctgagcagc aaggtgggccagcacctgcagctgcacgacagctacgaccgcgccagcaaggtctat ctgttcgagctgcacatcaccgatgcccagcctgccttcactggcagctaccgctgt gaggtgtccaccaaggacaaatttgactgctccaacttcaatctcactgtccacgag gccatgggcaccggagacctggacctcctatcagccttccgccgcacgagcctggct ggaggtggtcggcggatcagtgatagccatgaggacactgggattctggacttcagc tcactgctgaaaaagagagacagtttccggaccccgagggactcgaagctggaggca ccagcagaggaggacgtgtgggagatcctacggcaggcacccccatctgagtacgag cgcatcgccttccagtacggcgtcactgacctgcgcggcatgctaaagaggctcaag gcatgaggcgcgatgagaagaagagcacgcctttcagaagaagctggagccggcc taccaggtgagcaaaggccacaagatccggctgaccgtggaactggctgaccatgac gctgaggtcaaatggctcaagaatggccaggagatccagatgagcggcagcaagtac atctttgagtccatcggtgccaagcgtaccctgaccatcagccagtgctcattggcg gacgacgcagcctaccagtgcgtggtgggtggcgagaagtgtagcacggagctcttt gtgaaagagcccctgtgctcatcacgcgcccccttggaggaccagctggtgatggtg gggcagcgggtggagtttgagtgtgaagtatcggaggaggggcgcaagtcaaatgg ctgaaggacggggtggagctgaccggaggagagaccttcaaataccggttcaagaag gacgggcagagacaccacctgatcatcaacgaggccatgctggaggacgcggggcac tatgcactgtgcactagcgggggccaggcgctggctgagctcattgtgcaggaaaag aagctggaggtgtaccagagcatcgcagacctgatggtgggcgcaaaggaccaggcg gtgttcaaatgtgaggtctcagatgagaatgttcggggtgtgtggctgaagaatggg aaggagctggtgcccgacagccgcataaaggtgtcccacatcgggcgggtccacaaa ctgaccattgacgacgtcacacctgccgacgaggctgactacagctttgtgcccgag ggcttcgcctgcaacctgtcagccaagctccacttcatggaggtcaagattgacttc gtacccaggcaggaacctcccaagatccacctggactgcccaggccgcataccagac accattgtggttgtagctggaaataagctacgtctggacgtccctatctctgtgggac cccgctcccactgtgatctggcagaaggctatcacgcaggggaataaggccccagcc aggccagccccagatgccccagaggacacaggtgacagcgatgagtgggtgtttgac aagaagctgctgtgtgagaccgagggccgggtccgcgtggagaccaccaaggaccgc agcatcttcacggtcgagggggcagagaaggaagatgagggcgtctacacggtcaca gtgaagaaccctgtgggcgaggaccaggtcaacctcacagtcaaggtcatcgacgtg ccagacgcacctgcggcccccaagatcagcaacgtgggagaggactcctgcacagta cagtgggagccgcctgcctacgatggcgggcagcccatcctgggctacatcctggag cgcaagaagaagaagagctaccggtggatgcggctgaacttcgacctgattcaggag ctgagtcatgaagcgcggcgcatgatcgagggcgtggtgtacgagatgcgcgtctac gcggtcaacgccatcggcatgtccaggcccagccctgcctcccagccctccatgcct atcggtcccccagcgaacccacccacctggcagtagaggacgtctctgacaccacg gtctccctcaagtggcggccccagagcgcgtgggagcaggaggcctggatggctac agcgtggagtactcccagagggctgctcagagtgggtgcctgcaggggctg acagagcacacatcgatactggtgaaggacctgcccacggggcccggctgcttttc cgagtgcgggcacacaatatggcagggcctggagcccctgttaccaccacggagccg gtgacagtgcaggagatcctgcaacggccacggcttcagctgcccaggcacctgcgc cagaccattcagaagaaggtcgggagcctgtgaaccttctcatcccttttccaggge aagcccggcctcaggtgacctggaccaaagaggggcagcccctggcaggcgaggag gtgagcatccgcaacagccccacagacaccatcctgttcatccgggccgctcgccgc gtgcattcaggcacttaccaggtgacggtgcgcattgagaacatggaggacaaggcc acgctggtgctgcaggttgttgacaagccaagtcctcccccaggatctccgggtgact gacgcctggggtcttaatgtggctctggagtggaagccaccccaggatgtcggcaac acggaactctggggtacacagtcagaaagccgacaagaagaccatggagtggttc accgtcttggagcattaccgccgcacccactgcgtggtgccagagctcatcattggc aatggctactacttccgcgtcttcagccagaatatggttggctttagctgcagacg gccaccaccaaggagcccgtctttatcccagaccaggcatcacctatgagccaccc aactataaggccctggacttctccgaggcccaagcttcacccagccctggtgaac cgctcggtcatcgcgggctacactgctatgctctgctgtgctgtccggggtagccc aagcccaagatttcctggttcaagaatggcctggacctgggagaagacgcccgcttc cgcatgttcagcaagcagggagtgttgactctggagattagaaagccctgccccttt | 95 |

TABLE 5-continued

Illustrative expression cassette and viral genomes

| Name | DNA Sequence | SEQ ID NO. |
|---|---|---|
| | gacgggggcatctatgtctgcagggccaccaacttacagggcgaggcacggtgtgag tgccgcctggaggtgcgagtgcctcagtaaagcttaataaaagatctttattttcat tagatctgtgtgttggttttttgtgtgctggggactcgagttaagggcgaattcccg ataaggatcttcctagagcatggctacgtagataagtagcatggcgggttaatcatt aactaca | |
| 5' segment - partial viral genome (400 bp promoter) | tgtagttaatgattaacccgccatgctacttatctacgtagccatgctctaggaaga tcggaattcgcccttaagttgccttctgcccccccaaccctgctcccagctggccctc ccaggcctgggttgctggcctctgctttatcaggattctcaagagggacagctggtt tatgttgcatgactgttccctgcatatctgctctggttttaaatagcttatctgagc agctggaggaccacatgggcttatatggcgtggggtacatgttcctgtagccttgtc cctggcacctgccaaaatagcagccaacaccccccaccccaccgccatcccctgc cccacccgtccctgtcgcacattcctccctccgcagggctggctcaccaggcccca gcccacatgcctgcttaaagccctctccatcctctgcctcacccagtccccgctgag actgagcagacgcctccagccacc | 93 |
| 3' segment - partial viral genome | agcttaataaaagatctttattttcattagatctgtgtgttggttttttgtgtgctg gggactcgagttaagggcgaattcccgataaggatcttcctagagcatggctacgta gataagtagcatggcgggttaatcattaactaca | 94 |

In some aspects of the disclosure, an rAAV virion is used to deliver the expression cassettes described herein to cardiac cells of a subject, e.g. to treat cardiomyopathy. Accordingly, the disclosure provides an rAAV virion, the rAAV virion comprising an AAV capsid and an expression cassette comprising a polynucleotide encoding a transgene operatively linked to a promoter.

The rAAV virions of the disclosure comprise a capsid protein. Capsid proteins are structural proteins that make up the assembled icosahedral packaging of the rAAV virion that contains the expression cassette. Capsid proteins are classified by the serotype. Wild type capsid serotypes in rAAV virions can be, for example, AAV1, AAV2, AAV3, AAV4, AAV5, AAV6, AAV7, AAV8, AAV9, AAV10, AAV11, or AAV12 (Naso et al. BioDrugs 31:317-334 (2017)). Engineered capsid types include chimeric capsids and mosaic capsids (Choi et al. Curr Gene Ther. 5: 299-310 (2005)). Capsids are selected for rAAV virions based on their ability to transduce specific tissue or cell types (Liu et al. Curr Pharm Des. 21:3248-56 (2015)).

Any capsid protein that can facilitate rAAV virion transduction into cardiac cells for delivery of a transgene, as described herein, can be used. Capsid proteins used in rAAV virions for transgene delivery to cardiac cells that result in high expression can be, for example, AAV4, AAV6, AAV7, AAV8, and AAV9 (Zincarelli et al. Mol. Ther. 16:P1073-1080 (2008)). Artificial capsids, such as chimeric capsids generated through combinatorial libraries, can also be used for transgene delivery to cardiac cells that results in high expression (see U.S. 63/012,703, the contents of which are herein incorporated by reference). Other capsid proteins with various features can also be used in the rAAV virions of the disclosure. AAV vectors and capsids are provided in U.S. Pat. Pub. Nos. U.S. Ser. No. 10/011,640B2; U.S. Pat. No. 7,892,809B2, U.S. Pat. No. 8,632,764B2, U.S. Pat. No. 8,889,641B2, U.S. Pat. No. 9,475,845B2, U.S. Ser. No. 10/889,833B2, U.S. Ser. No. 10/480,011B2, and U.S. Ser. No. 10/894,949B2, the contents of which are herein incorporated by reference; and Intl Pat. Pub. Nos. WO2020198737A1, WO2019028306A2, WO2016054554A1, WO2018152333A1, WO2017106236A1, WO2008124724A1, WO2017212019A1, WO2020117898A1, WO2017192750A1, WO2020191300A1, and WO2017100671A1, the contents of which are herein incorporated by reference.

In some embodiments, the rAAV virions of the disclosure comprise an engineered capsid protein. Engineered capsid proteins can be derived from a parental, e.g. wild type, capsid and include, for example, variant polypeptide sequence with respect to a parental capsid sequence at one or more sites. For example, variant sites of the parental capsid can occur at the VR-IV site, VR-V site, VR-VII site and/or VR-VIII site (see, e.g. Burling and Srivastava. Mol Ther Methods Clin Dev. 12:248-265 (2019)).

In some embodiments, the capsid protein is an AAV5/AAV9 chimeric capsid protein. In some embodiments, the chimeric capsid protein comprises at least 1, 2, 3, 4, 5 or more polypeptide segments that are derived from AAV5 capsid protein (SEQ ID NO. 144). In some embodiments, the chimeric capsid protein comprises at least 1, 2, 3, 4, 5 or more polypeptide segments that are derived from AAV9 capsid protein (SEQ ID NO: 143). In some embodiments, at least one polypeptide segment is derived from the AAV5 capsid protein and at least one polypeptide segment is derived from the AAV9 capsid protein.

In some embodiments, the capsid protein is a combinatory capsid proteins. As used herein, "combinatory capsid protein" refers to a AAV5/AAV9 chimeric capsid protein, which further comprises amino acid variations with respect to the chimeric parental sequence at one or more sites. In some embodiments, the one or more sites of the chimeric parental sequence are selected from those equivalent to the VR-IV site, the VR-V site, the VR-VII site and the VR-VIII site of the AAV9 capsid protein.

In some embodiments, the rAAV virions comprise an engineered capsid protein selected from Table 6.

TABLE 6

Engineered Capsid Proteins

| Engineered Capsid | SEQ ID NO: |
|---|---|
| CR9-01 | 145 |
| CR9-07 | 146 |

TABLE 6-continued

Engineered Capsid Proteins

| Engineered Capsid | SEQ ID NO: |
|---|---|
| CR9-08 | 147 |
| CR9-09 | 148 |
| CR9-10 | 149 |
| CR9-11 | 150 |
| CR9-13 | 151 |
| CR9-14 | 152 |
| CR9-15 | 153 |
| CR9-16 | 154 |
| CR9-17 | 155 |
| CR9-20 | 156 |
| CR9-21 | 157 |
| CR9-22 | 158 |
| ZC23 | 159 |
| ZC24 | 160 |
| ZC25 | 161 |
| ZC26 | 162 |
| ZC27 | 163 |
| ZC28 | 164 |
| ZC29 | 165 |
| ZC30 | 166 |
| ZC31 | 167 |
| ZC32 | 168 |
| ZC33 | 169 |
| ZC34 | 170 |
| ZC35 | 171 |
| ZC40 | 172 |
| ZC41 | 173 |
| ZC42 | 174 |
| ZC43 | 175 |
| ZC44 | 176 |
| ZC45 | 177 |
| ZC46 | 178 |
| ZC47 | 179 |
| ZC48 | 180 |
| ZC49 | 181 |
| ZC50 | 182 |
| TN47-07 | 183 |
| TN47-10 | 184 |
| TN47-13 | 185 |
| TN47-14 | 186 |
| TN47-17 | 187 |
| TN47-22 | 188 |
| TN40-07 | 189 |
| TN40-10 | 190 |
| TN40-13 | 191 |
| TN40-14 | 192 |
| TN40-17 | 193 |
| TN40-22 | 194 |
| TN44-07 | 195 |
| TN44-10 | 196 |
| TN44-13 | 197 |
| TN44-14 | 198 |
| TN44-17 | 199 |
| TN44-22 | 200 |

In some embodiments, the rAAV is replication defective, in that the rAAV virion cannot independently further replicate and package its genome. For example, when a cardiac cell is targeted with rAAV virions, the transgene is expressed in the targeted cardiac cell, however, due to the fact that the targeted cardiac cell lacks AAV rep and cap genes and accessory function genes, the rAAV is not able to replicate.

In some embodiments, rAAV virions of the present disclosure encapsulating the expression cassettes as described herein, can be produced using helper-free production. rAAVs are replication-deficient viruses and normally require components from a live helper virus, such as adenovirus, in a host cell for packaging of infectious rAAV virions. rAAV helper-free production systems allow the production of infectious rAAV virions without the use of a live helper virus. In the helper-free system, a host packaging cell line is co-transfected with three plasmids. A first plasmid may contain adenovirus gene products (e.g. E2A, E4, and VA RNA genes) needed for the packaging of rAAV virions. A second plasmid may contain required AAV genes (e.g., REP and CAP genes). A third plasmid contains the polynucleotide sequence encoding the transgene of interest and a promoter flanked by ITRs. A host packaging cell line can be, for example, AAV-293 host cells. Suitable host cells contain additional components required for packaging infectious rAAV virions that are not supplied by the plasmids. In some embodiments, the CAP genes can encode, for example, AAV capsid proteins as described herein.

IV. Methods of Treatment

The present disclosure also provides pharmaceutical compositions comprising the rAAV vector genomes or rAAV virions disclosed herein and one or more pharmaceutically acceptable carriers, diluents or excipients. In particular embodiments, the pharmaceutical composition comprises an rAAV vector genome or rAAV virion as described herein, comprising a polynucleotide sequence that encodes a therapeutic protein or nucleic acid, operatively linked to a cardiac-specific promoter (e.g., a modified TNNT2 promoter). For example, in some embodiments, the pharmaceutical composition is an AAV9 vector comprising the modified cardiac TNNT2 promoter (SEQ ID NO: 3) operatively linked to the MYBPC3 protein (SEQ ID NO: 86). Provided are pharmaceutical compositions, e.g., for use in preventing or treating cardiomyopathy, which comprises a therapeutically effective amount of a vector that comprises a polynucleotide sequence encoding a therapeutic protein or nucleic acid that can restore contractile function in the heart.

The disclosure provides methods for expressing a polynucleotide a cell. The method may comprise, for example, transducing a target cell with the rAAV virions, rAAV vector genomes, or expression cassettes described herein. A target cell can be, for example and without limitation, a cardiac cell, a muscle cell, an induced pluripotent stem cell-derived cardiomyocyte (iPSC-CM), a cardiomyocyte, or a MYBPC3$^{-/-}$ iPSC-CM. In one aspect, a method of expressing a MYBPC3 protein in a cell comprises transducing a target cell or population of target cells with an rAAV virion or rAAV vector genomes described herein. In one embodiment, the cell is a MYBPC3$^{-/-}$ cell. In one embodiment, the cell comprises an inactivating mutation in one or both copies of the endogenous MYBPC3 gene.

The compositions that are described herein can be employed in a method of treating a subject with a cardiac disease or condition. "Treating" or "treatment of a condition or subject in need thereof" refers to (1) taking steps to obtain beneficial or desired results, including clinical results such as the reduction of symptoms; (2) preventing the disease, for example, causing the clinical symptoms of the disease not to develop in a patient that may be predisposed to the disease, but does not yet experience or display symptoms of the disease; (3) inhibiting the disease, for example, arresting or reducing the development of the disease or its clinical symptoms; (4) relieving the disease, for example, causing regression of the disease or its clinical symptoms; or (5) delaying the disease. For purposes of this invention, beneficial or desired clinical results include, but are not limited to, promoting cardiac sarcomere contraction.

Subjects in need of treatment using the compositions and methods of the present disclosure include, but are not limited to, individuals having a congenital heart defect, individuals suffering from a degenerative muscle disease, individuals suffering from a condition that results in ischemic heart tissue (e.g., individuals with coronary artery disease), and the like. In some examples, a method is useful to treat a degenerative muscle disease or condition (e.g., familial cardiomyopathy, dilated cardiomyopathy, hypertrophic cardiomyopathy, restrictive cardiomyopathy, or coronary artery disease with resultant ischemic cardiomyopathy). In some examples, a subject method is useful to treat individuals having a cardiac or cardiovascular disease or disorder, for example, cardiovascular disease, aneurysm, angina, arrhythmia, atherosclerosis, cerebrovascular accident (stroke), cerebrovascular disease, congenital heart disease, congestive heart failure, myocarditis, valve disease coronary, artery disease dilated, diastolic dysfunction, endocarditis, high blood pressure (hypertension), cardiomyopathy, hypertrophic cardiomyopathy, restrictive cardiomyopathy, coronary artery disease with resultant ischemic cardiomyopathy, mitral valve prolapse, myocardial infarction (heart attack), or venous thromboembolism. In some examples, the subject is suffering from or at risk for cardiomyopathy.

In some embodiments, the compositions and methods disclosed herein can be used for the prevention and/or treatment of cardiomyopathies in a subject. In some embodiments, the compositions and methods described herein can be used to treat cardiomyopathies affiliated with mutations in cardiac myosin binding protein C (MYBPC3), such as hypertrophic cardiomyopathy and familial hypertrophic cardiomyopathy. The cardiomyopathy treated by the compositions and methods described herein can also include cardiomyopathies associated with a pulmonary embolus, a venous thrombosis, a myocardial infarction, a transient ischemic attack, a peripheral vascular disorder, atherosclerosis, ischemic cardiac disease and/or other myocardial injury or vascular disease. In certain embodiments, the cardiomyopathies treated by the compositions and methods described herein can include cardiac diseases associated with myocardial tissue hypercontractility, such as heart failure related to left ventricular hypercontractility.

In some embodiments, the compositions and methods described herein can induce detectable expression of a therapeutic protein or nucleic acid (e.g., MYBPC3 protein), or a mutant, variant, or fragment thereof, to modulate contractile function of the myocardial tissue in a subject in need thereof. In some embodiments, the amount, concentration, and volume of the composition that modulates contractile function in myocardial tissue administered to a subject can be controlled and/or optimized to substantially improve the functional parameters of the heart while mitigating adverse side effects.

The amount of the composition that modulates contractile function administered to myocardial tissue can also be an amount required to result in the detectable expression of a therapeutic protein or nucleic acid (e.g., MYBPC3 protein) or a mutant, variant, or fragment thereof in the heart; preserve and/or improve contractile function; delay the emergence of cardiomyopathy or reverse the pathological course of the disease; increase myocyte viability; improve myofilament function; inhibit left ventricular hypertrophy; cardiac hypertrophy regression, normalize systolic and diastolic function in heart; and restore normal cross-bridge behavior at the myofilament level.

In some embodiments, the compositions and methods disclosed herein results in detectable expression of MYBPC3 protein, or a mutant, variant, or fragment thereof, in a cardiac cell of the subject being treated. In some embodiments, administration of an rAAV vector genome or rAAV virion described herein causes specific expression of MYBPC3 protein in the heart of the subject. In some embodiments, administration of rAAV vector genome or rAAV virion described herein causes low or undetectable expression of MYBPC3 in the skeletal tissue, brain, and/or liver of the subject, wherein optionally the subject suffers from or is at risk for cardiomyopathy.

In some embodiments, the compositions and methods disclosed herein results in detectable expression of KCNH2 protein, or a mutant, variant, or fragment thereof, in a cardiac cell of the subject being treated.

In some embodiments, the compositions and methods disclosed herein results in detectable expression of TRPM4 protein, or a mutant, variant, or fragment thereof, in a cardiac cell of the subject being treated.

In some embodiments, the compositions and methods disclosed herein results in detectable expression of DSG2 protein, or a mutant, variant, or fragment thereof, in a cardiac cell of the subject being treated.

In some embodiments, the compositions and methods disclosed herein results in detectable expression of ATP2A2 protein, or a mutant, variant, or fragment thereof, in a cardiac cell of the subject being treated.

In some embodiments, the compositions and methods disclosed herein results in detectable expression of CACNA1C, DMD, DMPK, EPG5, EVC, EVC2, FBN1, NF1, SCN5A, SOS1, NPR1, ERBB4, VIP, or MYH7, or a mutant, variant, or fragment thereof, in a cardiac cell of the subject being treated.

"Detectable expression" typically refers to expression at least 5%, 10%, 15%, 20% or more compared to a control subject or tissue not treated with the vector. In some embodiments, detectable expression means expression at 1.5-fold, 2-fold, 2.5-fold, or 3-fold greater than a no-vector control. Expression can be assess by Western blot, as described in the example that follows, or enzyme-linked immunosorbent assay (ELISA), or other methods known in the art. In some cases, expression is measured quantitatively using a standard curve. Standard curves can be generated using purified protein, e.g. purified MYBPC3 protein, by methods described in the examples or known in the art. Alternatively, expression of the therapeutic gene product can be assessed by quantification of the corresponding mRNA.

In some embodiments, the detectable expression of the therapeutic gene product in heart tissue occurs at doses, in vector genomes (vg) per kilogram weight of subject (kg), of $3\times10^{14}$ vg/kg or less, $2\times10^{14}$ vg/kg or less, $1\times10^{14}$ vg/kg or less, $9\times10^{13}$ vg/kg or less, $8\times10^{13}$ vg/kg or less, $7\times10^{13}$ vg/kg or less, $6\times10^{13}$ vg/kg or less, $5\times10^{13}$ vg/kg or less, $4\times10^{13}$ vg/kg or less, $3\times10^{13}$ vg/kg or less, $2\times10^{13}$ vg/kg or less, or $1\times10^{13}$ vg/kg or less.

In various embodiments, the compositions described herein contain the rAAV virions or vector genomes described herein and one or more pharmaceutically acceptable excipients. Pharmaceutically acceptable excipients can include vehicles (e.g., carriers, diluents and excipients) that are pharmaceutically acceptable for a formulation capable of being injected. These may be in particular isotonic, sterile, saline solutions (monosodium or disodium phosphate, sodium, potassium, calcium or magnesium chloride and the like or mixtures of such salts), or dry, especially freeze-dried compositions which upon addition, depending on the case, of sterilized water or physiological saline, permit the constitution of injectable solutions. Illustrative pharmaceutical forms suitable for injectable use include, e.g., sterile aqueous solutions or dispersions; formulations including sesame oil, peanut oil or aqueous propylene glycol; and sterile powders for the extemporaneous preparation of sterile injectable solutions or dispersions.

In various embodiments, the pharmaceutical compositions of the disclosure comprise about $1\times10^8$ genome copies per milliliter (GC/mL), about $5\times10^8$ GC/mL, about $1\times10^9$ GC/mL, about $5\times10^9$ GC/mL, about $1\times10^{10}$ GC/mL, about $5\times10^{10}$ GC/mL, about $1\times10^{11}$ GC/mL, about $5\times10^{11}$ GC/mL, about $1\times10^{12}$ GC/mL, about $5\times10^{12}$ GC/mL, about $5\times10^{13}$ GC/mL, about $1\times10^{14}$ GC/mL, or about $5\times10^{14}$ GC/mL of the viral vector (e.g. rAAV virion).

In various embodiments, the pharmaceutical compositions of the disclosure comprise about $1\times10^8$ viral genomes per milliliter (vg/mL), about $5\times10^8$ vg/mL, about $1\times10^9$ vg/mL, about $5\times10^9$ vg/mL, about $1\times10^{10}$ vg/mL, about $5\times10^{10}$ vg/mL, about $1\times10^{11}$ vg/mL, about $5\times10^{11}$ vg/mL, about $1\times10^{12}$ vg/mL, about $5\times10^{12}$ vg/mL, about $5\times10^{13}$ vg/mL, about $1\times10^{14}$ vg/mL, or about $5\times10^{14}$ vg/mL of the viral vector (e.g. rAAV virion).

In some embodiments, the pharmaceutical compositions of the disclosure are administered in a total volume of about 1 mL, 5 mL, 10 mL, about 20 mL, about 25 mL, about 30 mL, about 35 mL, about 40 mL, about 45 mL, about 50 mL, about 55 mL, about 60 mL, 65 mL, about 70 mL, about 75 mL, about 80 mL, about 85 mL, about 90 mL, about 95 mL, about 100 mL, about 105 mL, about 110 mL, about 115 mL, about 120 mL, about 125 mL, about 130 mL, about 135 mL, about 140 mL, about 145 mL, about 150 mL, about 155 mL, about 160 mL, about 165 mL, about 170 mL, about 175 mL, about 180 mL, about 185 mL, about 190 mL, about 200 mL, about 205 mL, about 210 mL, about 215 mL, or about 220 mL.

In some embodiments, the methods of the disclosure comprise administering an rAAV virion encoding MYBPC3 at a dose of about $1\times10^8$ genome copies per milliliter (GC/mL), about $5\times10^8$ GC/mL, about $1\times10^9$ GC/mL, about $5\times10^9$ GC/mL, about $1\times10^{10}$ GC/mL, about $5\times10^{10}$ GC/mL, about $1\times10^{11}$ GC/mL, about $5\times10^{11}$ GC/mL, about $1\times10^{12}$ GC/mL, about $5\times10^{12}$ GC/mL, about $5\times10^{13}$ GC/mL, about $1\times10^{14}$ GC/mL, or about $5\times10^{14}$ GC/mL of the rAAV virion.

In preferred embodiments, the methods of the disclosure comprise intravenously administering an rAAV virion encoding MYBPC3 at a dose of about $3\times10^{12}$ GC/mL, about $3\times10^{13}$ GC/mL, about $1\times10^{14}$ GC/mL, or about $3\times10^{14}$ GC/mL of the rAAV virion.

In preferred embodiments, the methods of the disclosure comprise administering, by localized delivery to the heart, an rAAV virion encoding MYBPC3 at a dose of about $3\times10^{11}$ GC/mL, about $3\times10^{12}$ GC/mL, about $1\times10^{13}$ GC/mL, or about $3\times10^{13}$ GC/mL of the rAAV virion.

In some embodiments, the methods of the disclosure comprise administering an rAAV virion encoding MYBPC3 at a dose of about $1\times10^8$ viral genomes per milliliter (vg/mL), about $5\times10^8$ vg/mL, about $1\times10^9$ vg/mL, about $5\times10^9$ vg/mL, about $1\times10^{10}$ vg/mL, about $5\times10^{10}$ vg/mL, about $1\times10^{11}$ vg/mL, about $5\times10^{11}$ vg/mL, about $1\times10^{12}$ vg/mL, about $5\times10^{12}$ vg/mL, about $5\times10^{13}$ vg/mL, about $1\times10^{14}$ vg/mL, or about $5\times10^{14}$ vg/mL of the rAAV virion.

In preferred embodiments, the methods of the disclosure comprise intravenously administering an rAAV virion encoding MYBPC3 at a dose of about $3\times10^{12}$ vg/mL, about $3\times10^{13}$ vg/mL, about $1\times10^{14}$ vg/mL, or about $3\times10^{14}$ vg/mL of the rAAV virion.

In preferred embodiments, the methods of the disclosure comprise administering, by localized delivery to the heart, an rAAV virion encoding MYBPC3 at a dose of about $3\times10^{11}$ vg/mL, about $3\times10^{12}$ vg/mL, about $1\times10^{13}$ vg/mL, or about $3\times10^{13}$ vg/mL of the rAAV virion.

Genome copies per milliliter can be determined by quantitative polymerase change reaction (qPCR) using a standard curve generated with a reference sample having a known concentration of the polynucleotide genome of the virus. For AAV, the reference sample used is often the transfer plasmid used in generation of the rAAV virion but other reference samples may be used.

Alternatively or in addition, the concentration of a viral vector can be determined by measuring the titer of the vector on a cell line. Viral titer is typically expressed as viral particles (vp) per unit volume (e.g., vp/mL). In various embodiments, the pharmaceutical compositions of the disclosure comprise about $1\times10^8$ viral particles per milliliter (vp/mL), about $5\times10^8$ vp/mL, about $1\times10^9$ vp/mL, about $5\times10^9$ vp/mL, about $1\times10^{10}$ vp/mL, about $5\times10^{10}$ vp/mL, about $1\times10^{11}$ vp/mL, about $5\times10^{11}$ vp/mL, about $1\times10^{12}$ vp/mL, about $5\times10^{12}$ vp/mL, about $5\times10^{13}$ vp/mL, or about $1\times10^{14}$ vp/mL, or about $5\times10^{14}$ of the viral vector (e.g., rAAV virion).

In one embodiment, the present disclosure provides a kit comprising a container housing a pharmaceutical composition as described herein.

The rAAV virions or vector genomes of the present disclosure can be administered to a subject in need thereof by systemic application, e.g., by intravenous, intra-arterial or intraperitoneal delivery of a vector in analogy to what has been shown in animal models (Katz et al., 2012, *Gene Ther.* 19:659-669. In some embodiments, the rAAV virions or vector genomes of the present disclosure treat or prevent hypertrophic cardiomyopathy, wherein the vector is administered systemically.

In some embodiments, the rAAV virions or vector genomes of the present disclosure can be delivered by direct administration to the heart tissue, e.g. by intracoronary administration. In some embodiments, the vectors are administered as a single dose by antegrade epicardial coronary artery infusion over a 10-minute period in a cardiac catheterization laboratory after angiography (percutaneous intracoronary delivery without vessel balloon occlusion) with the use of standard 5F or 6F guide or diagnostic catheters (Jaski et al., 2009, *J Card Fail.* 15: 171-181).

Subjects who are suitable for treatment using the compositions, compositions and methods of the present disclosure include individuals (e.g., mammalian subjects, such as humans, non-human primates, domestic mammals, experimental non-human mammalian subjects such as mice, rats, etc.) having a cardiac condition.

In some embodiments, the rAAV virions or vector genomes of the present disclosure can be used to treat a subject in need thereof. In some embodiments, the viral vector can be administered to the subject in need to treat a cardiovascular disease. In some embodiments, the rAAV virions or vector genomes are administered to a subject to treat cardiomyopathy. In some embodiments, the viral vector is administered systemically. In other embodiments, the viral vector is delivered by direct administration to the heart tissue.

rAAV virions or vector genomes can be administered by various routes, including without limitation direct injection into the heart or cardiac catheterization. In a preferred embodiment, a pharmaceutical composition comprising an rAAV virion encoding MYBPC3 is administered by intracardiac catheter delivery via retrograde coronary sinus infusion (RCSI). Alternatively, the viral vector can be administered systemically such as by intravenous infusion. When direct injection is used, it may be performed either by open-heart surgery or by minimally invasive surgery. In some cases, the viral vector is delivered to the pericardial space by injection or infusion.

The viral vector administered to the subject can be traced by a variety of methods. For example, recombinant viruses labeled with or expressing a marker (such as green fluorescent protein, or beta-galactosidase) can readily be detected. The recombinant viruses may be engineered to cause the target cell to express a marker protein, such as a surface-expressed protein or a fluorescent protein. Alternatively, the infection of target cells with recombinant viruses can be detected by their expression of a cell marker that is not expressed by the animal employed for testing (for example, a human-specific antigen when injecting cells into an experimental animal). The presence and phenotype of the target cells can be assessed by fluorescence microscopy (e.g., for green fluorescent protein, or beta-galactosidase), by immunohistochemistry (e.g., using an antibody against a human antigen), by ELISA (using an antibody against a human antigen), or by RT-PCR analysis using primers and hybridization conditions that cause amplification to be specific for RNA indicative of a cardiac phenotype.

All patents, patent publications, and other publications referenced and identified in the present specification are individually and expressly incorporated herein by reference in their entirety for all purposes.

EXAMPLES

Example 1: Design of Vector Genome for Large Cargos

The purpose of this study was to evaluate a vector having deletions in non-coding portions of the vector to a parental vector. It demonstrates that, surprisingly, deletion in non-coding regions increases potency of the vector.

With two intact flanking ITR sequences (each ~130 bp), promoter, intron, WPRE and polyadenylation signal, and standard cis-regulatory sequences for optimal transgene expression, typical AAV vector genomes require about 1.8-2.0 kbp of non-coding DNA sequence. Trangenes of about 3.0 kbp or greater, like the 3.8 kbp transgene MYBPC3, cause the vector genome to exceed 5.0 kbp. For example, Mearini et al., *Nat Commun* 5:5515 (2014) reports an AAV vector encoding MYBPC3 having a vector genome size of 5.4 kbp. Without ITR sequences, this is about 5.2 kbp.

A reporter system was generated to test whether an AAV vector would tolerate shortened non-coding regions. A conventional AAV vector having a CAG promoter, intron, WPRE, and standard polyA sequence was modified to remove the WPRE (589 bp) and to shorten the polyA sequence (removing 170 bp) (FIG. 1A). Expression of a GFP reporter cloned into the multiple cloning site (MCS) was maintained but slightly decreased when these vector elements were deleted or shortened (FIG. 1B). The vector was further truncated by deletion of the intron and a portion of the sequence 3' to the 5' ITR (FIG. 1C). The final vector genome was about 1.1 kpb (0.8 kpb without ITRs).

Example 2: MYBPC3 Transgene Expression in Induced Cardiomyocytes In Vitro

The purpose of this study was to provide an improved tissue-specific promoter for expression of a therapeutic gene product in induced cardiomyocytes in vitro using an AAV-based vector system. Human induced pluripotent stem cells (iPSCs) were differentiated into cardiomyocytes using mesoderm induction, cardiac specification and metabolic selection as previously described (Tohyama et al. *Cell Stem Cell.* 2013; 12(1):127-37; Lian et al. *Proc Natl Acad Sci USA.* 2012; 109(27):E1848-57; Burridge PW, Holmstrom A, Wu J C. *Curr Protoc Hum Genet.* 2015; 87:21 3 1-15) iPSC-CM viral transductions were performed with AAV6 at the indicated multiplicities of infection.

The gene expression cassettes depicted in FIG. 2A were constructed for an AAV-based vector system for the treatment of cardiomyopathy. The AAV vector, based on the vector depicted in FIG. 1C, comprised several cis-regulatory elements, including two inverted terminal repeats (ITRs, 260 bp each), a polyadenylation signal (A, 49 bp), and a full-length (SEQ ID NO: 1) or modified cardiac troponin T (TNNT2) promoter (SEQ ID NO: 2-4). No WPRE was included, and the polyA signal and the sequence 3' to the 5' ITR were both shortened. The modified TNNT2 promoters contained 100-200 bp deletions at the 5' (upstream) end of the wild-type TNNT2 promoter. Human myosin binding protein C (MYBPC3, SEQ ID NO: 86) with a polynucleotide sequence length of 3.825 kb was tested as the therapeutic gene product in iPSC-derived cardiomyocytes.

To determine whether wild-type or modified TNNT2 promoters could induce detectable expression of the MYBPC3 protein, MYBPC3$^{-/-}$ iPSC-derived cardiomyocytes were transduced with AAV6 particles at 6×10$^4$ MOI. Cells were analyzed for MYBPC3 protein expression by immunofluorescence or Western blot 5-15 days post-infection.

Figure 2B:
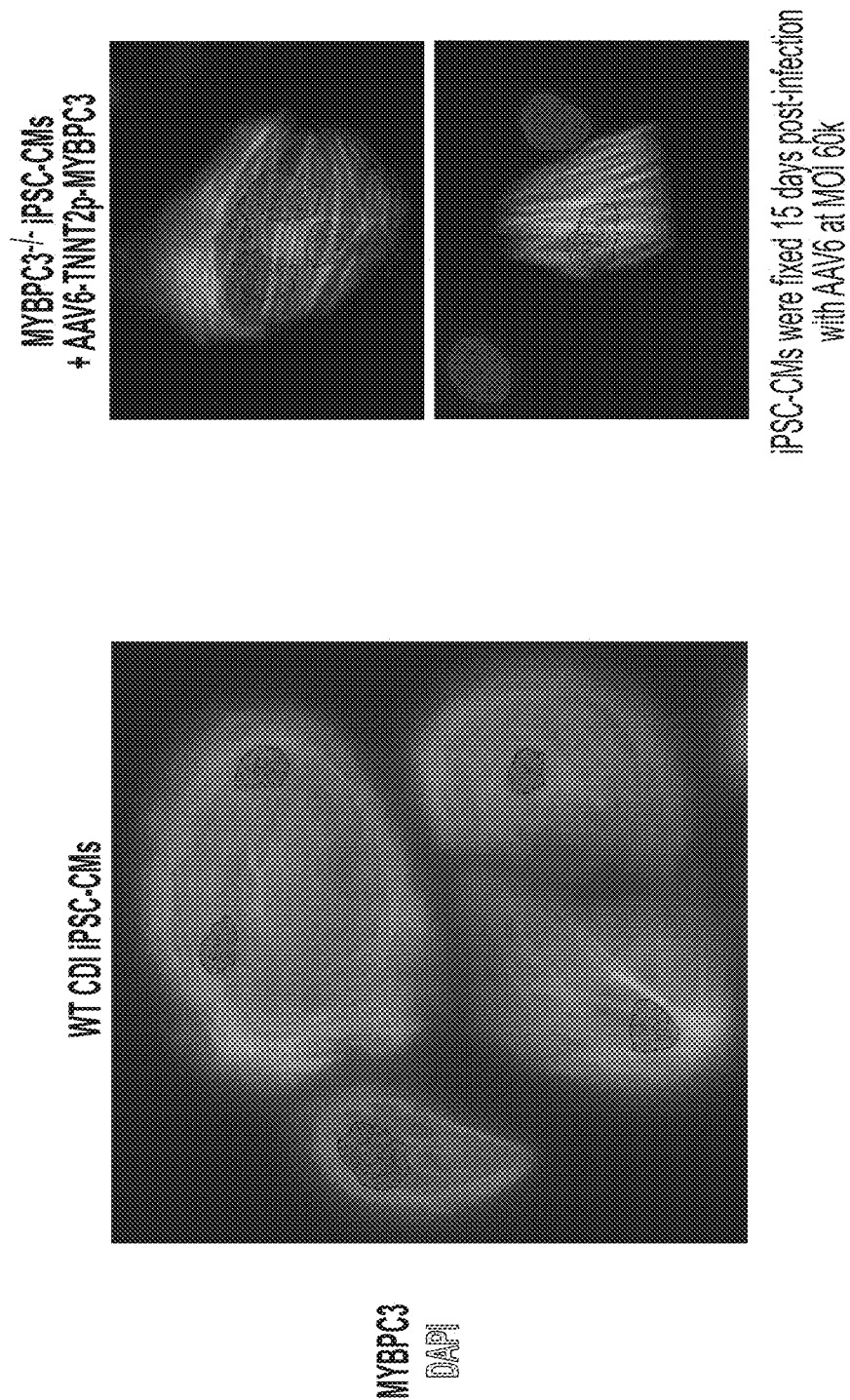
FIG. 2B shows detection of MYBPC3 protein by immunofluorescence in MYBPC3$^{-/-}$ iPSC-derived cardiomyocytes transduced with AAV6-packaged constructs encoding MYBPC3 driven by the cardiac-specific TNNT2 promoter.

FIG. 2B shows that the AAV vector comprising the wild-type TNNT2 promoter (SEQ ID NO: 1) drives expression of MYBPC3 protein in the sarcomeres of MYBPC3$^{-/-}$ iPSC-derived cardiomyocytes.

Figure 3A:
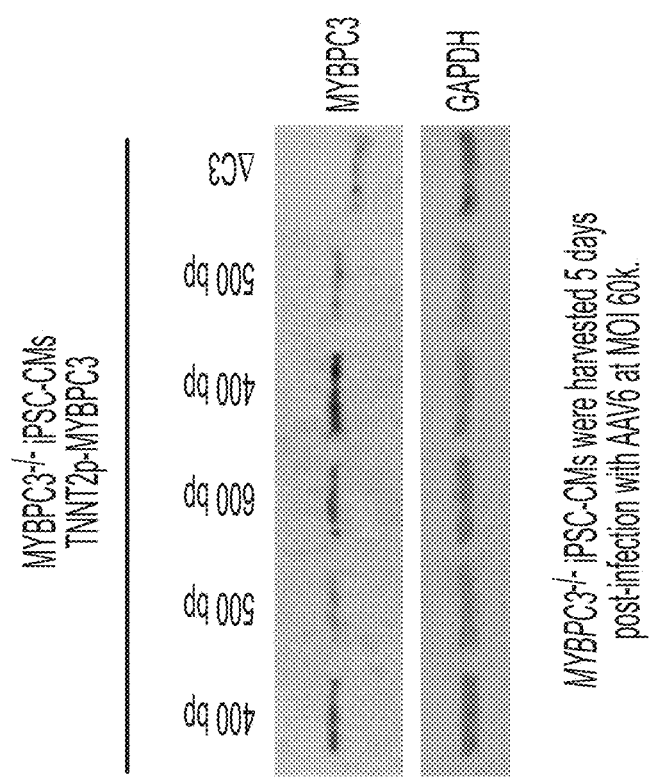
FIG. 3A shows detection of MYBPC3 protein by Western blot in MYBPC3$^{-/-}$ iPSC-derived cardiomyocytes transduced with AAV6-packaged constructs encoding human MYBPC3 driven by various sizes (400-600 bp) of the cardiac-specific TNNT2 promoter. GAPDH was used as a loading control.
Figures 3B, 3C:
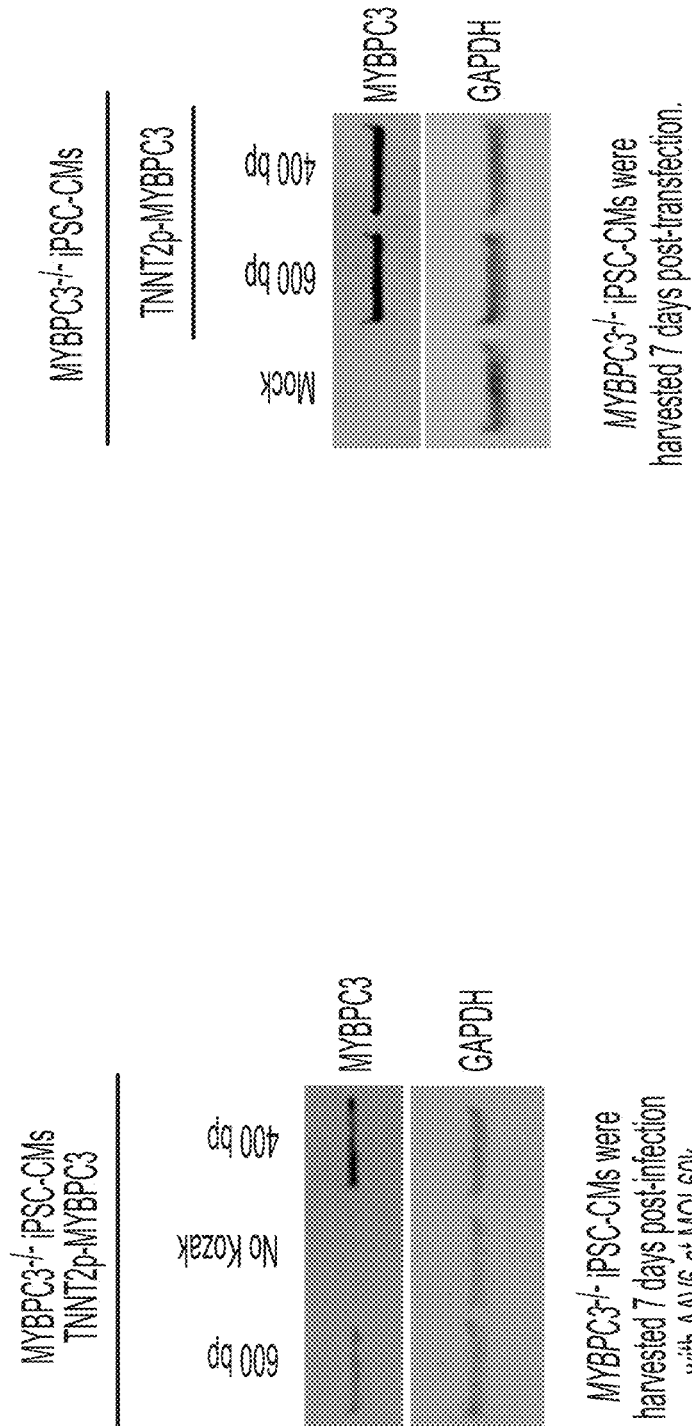
FIG. 3B shows detection of MYBPC3 protein by Western blot in MYBPC3$^{-/-}$ iPSC-derived cardiomyocytes transduced with AAV6-packaged constructs encoding human MYBPC3 driven by various sizes (400 or 600 bp) of the human cardiac TNNT2 promoter. No Kozak sequence was used as a negative control and GAPDH was used as a loading control.
FIG. 3C shows detection of MYBPC3 protein by Western blot in MYBPC3$^{-/-}$ iPSC-derived cardiomyocytes transfected with AAV6 plasmids encoding human MYBPC3 driven by various sizes (400 or 600 bp) of the human cardiac TNNT2 promoter. GAPDH was used as a loading control.

FIG. 3A-FIG. 3C show that the AAV vector comprising the 400 bp modified TNNT2 promoter (SEQ ID NO: 3) drives higher MYBPC3 protein expression than either the 600 bp wild-type TNNT2 (SEQ ID NO: 1) or 500 bp modified TNNT2 (SEQ ID NO: 2) promoters in transduced MYBPC3$^{-/-}$ iPSC-derived cardiomyocytes. In contrast, MYBPC3$^{-/-}$ iPSC-derived cardiomyocytes transfected with a plasmid (rather than transduced with virus) encoding MYBPC3 under the control of either the 600 bp wild-type TNNT2 (SEQ ID NO:1) or 400 bp modified TNNT2 promoter (SEQ ID NO: 3) showed similar MYBPC3 protein expression.

Example 3: Mybpc3$^{-/-}$ Mice Model Hypertrophic Severe Cardiomyopathy

Figure 4B:
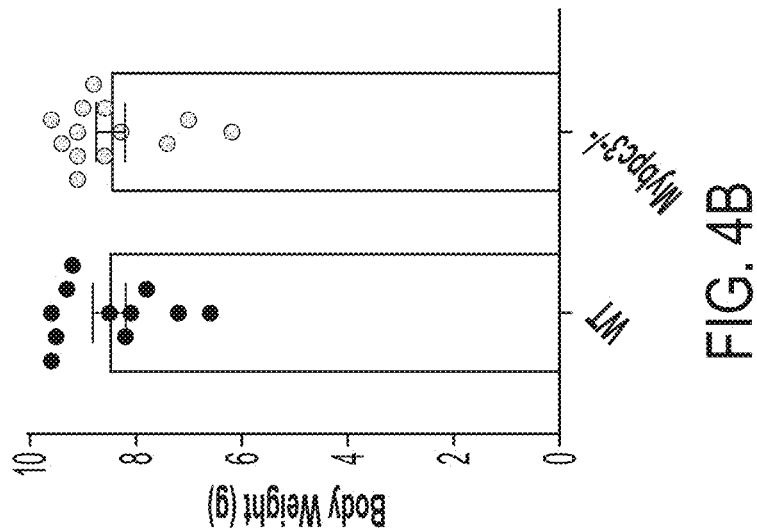
FIG. 4B shows a bar graph of body weight of wild-type (WT) or KO mice (Mybpc3$^{-/-}$) littermates at two weeks of age. WT (n=11), Mybpc3$^{+/-}$ (n=7) and Mybpc3$^{-/-}$ (n=13).
Figure 4A:
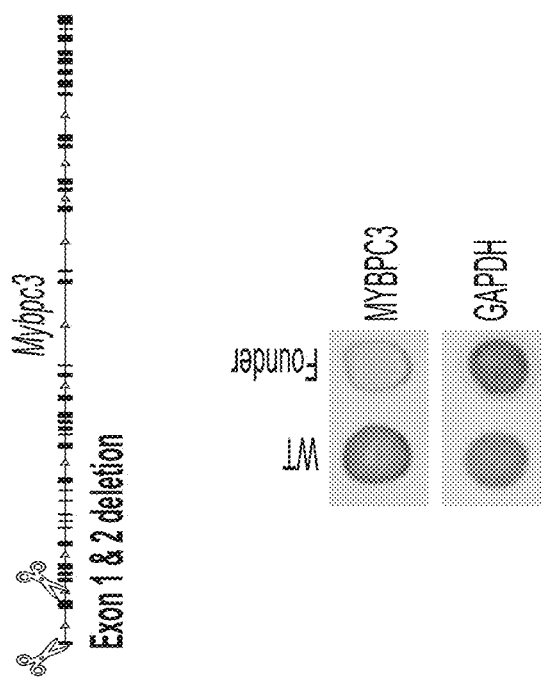
FIG. 4A shows a map of the introns of the Mybpc3 gene and a dot blot of MYBPC3 protein expression in the founder mouse of the KO line.
Figure 4C:
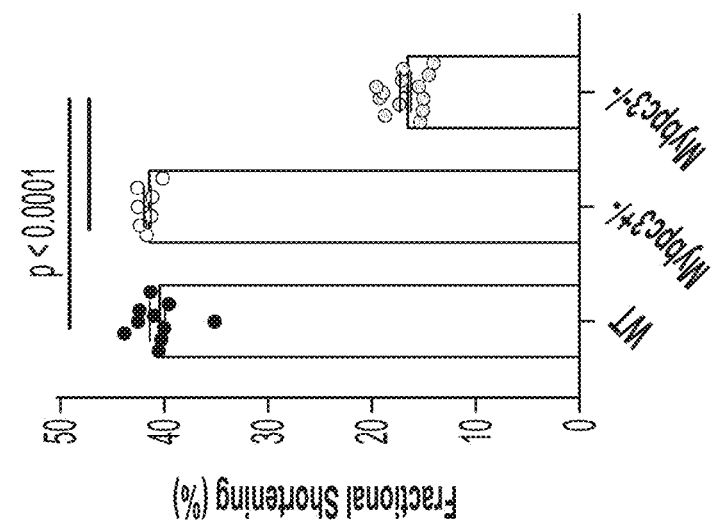
FIG. 4C shows a bar graph of ejection fraction (%) measured by echocardiography in wild-type (WT), heterozygous KO mice (Mybpc3$^{+/-}$), or homozygous KO mice (Mybpc3$^{-/-}$) at two weeks of age.
Figure 4D:
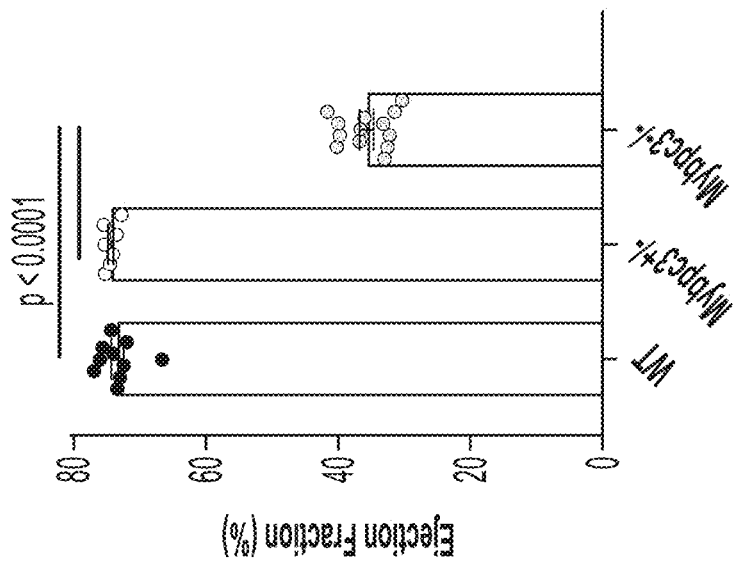
FIG. 4D shows a bar graph of fractional shortening measured by echocardiography in wild-type (WT), heterozygous KO mice (Mybpc3$^{+/-}$), or homozygous KO mice (Mybpc3$^{-/-}$) at two weeks of age.
Figure 4F:
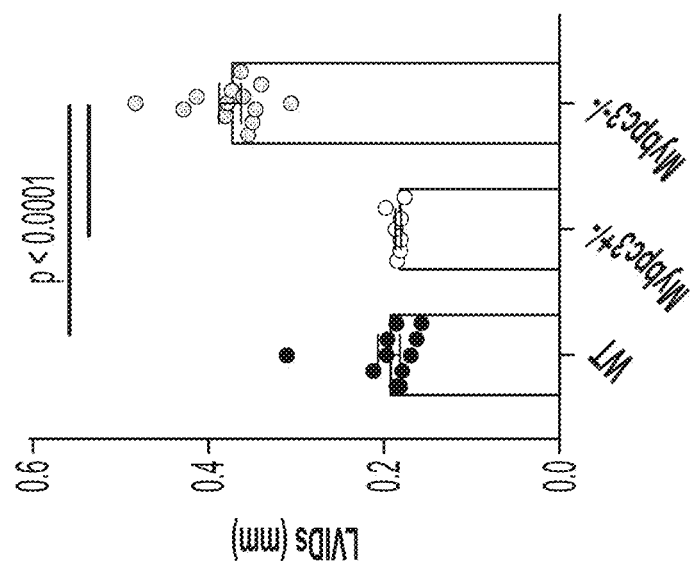
FIG. 4F shows a bar graph of Left ventricular internal diameter during systole (LVIDs) normalized by body weight in wild-type (WT), heterozygous KO mice (Mybpc3$^{+/-}$), or homozygous KO mice (Mybpc3$^{-/-}$) at two weeks of age.
Figure 4E:
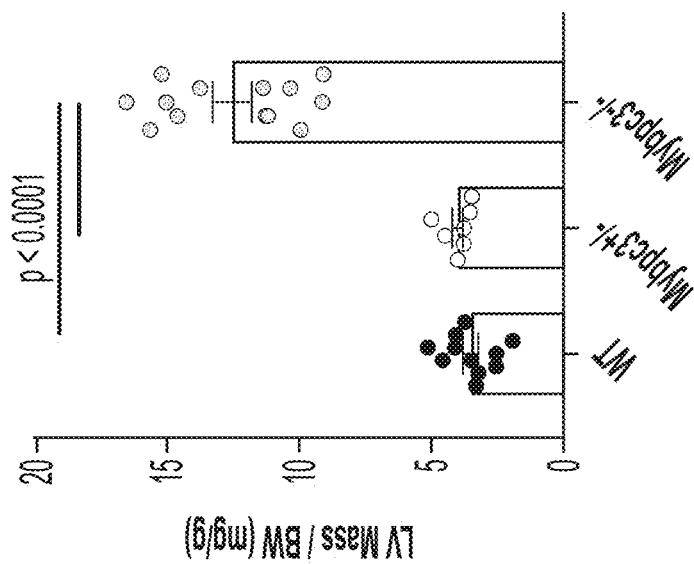
FIG. 4E shows a bar graph of left ventricular (LV) mass normalized by body weight (BW) in wild-type (WT), heterozygous KO mice (Mybpc3$^{+/-}$), or homozygous KO mice (Mybpc3$^{-/-}$) at two weeks of age.
Figure 4G:
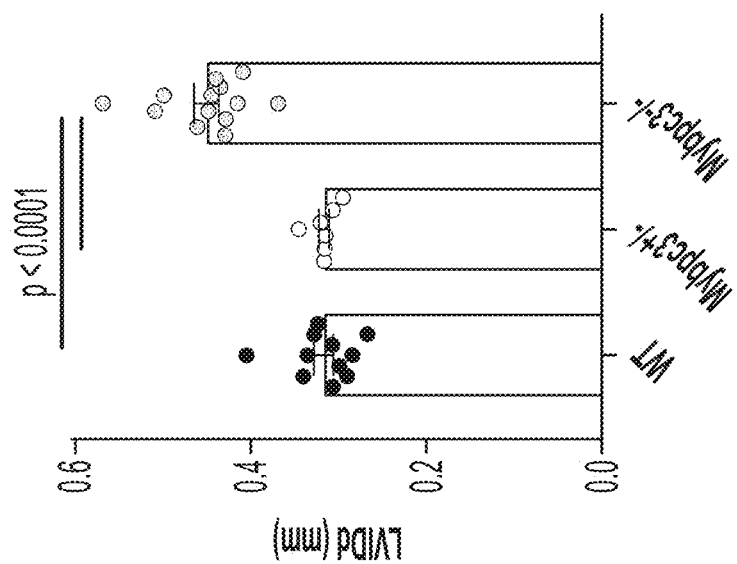
FIG. 4G shows a bar graph of Left ventricular internal diameter during diastole (LVIDd) normalized by body weight in wild-type (WT), heterozygous KO mice (Mybpc3$^{+/-}$), or homozygous KO mice (Mybpc3$^{-/-}$) at two weeks of age.

Homozygous Mybpc3 knockout mice (KO) were generated on a C57Bl/6 background by a CRISPR-Cas9 paired gRNA deletion of exons one and two (FIG. 4A). KO mice exhibited severe deficits in cardiac function (FIG. 4C and FIG. 4D) and pronounced cardiac hypertrophy (FIGS. 4E-4G) at two weeks of age, despite normal Mendelian ratios and comparable body weight to wild-type littermates (FIG. 4B). This model has more severe cardiac hypertrophy than other models (Schlossarek et al. *Basic Res. Cardiol.* 107:1-13 (2012)). Our KO mice exhibit severe, early-onset HCM in juveniles (two-week-old mice) that models pediatric onset of HCM in humans, as well as late-stage HCM in adults. See Lekanne Deprez et al., *J Med Genet* 43:829-832 (2006); Xin et al., *Am J Med Genet* Part A 143A:2662-2667 (2007); Zahka et al., *Heart* 94:1326-1330 (2008); Marziliano et al., *Neonatology* 102:254-258 (2012); Wessels et al., *Eur J Hum Genet* 23:922-928 (2015).

Example 4: MYBPC3 Transgene Expression in Heart Tissue In Vivo

The purpose of this study was to examine therapeutic protein expression in vivo using an AAV-based vector system comprising a modified cardiac-specific promoter.

Adult mice were retro-orbitally injected with AAV9 recombinant virus comprising either the 600 bp wild-type TNNT2 (SEQ ID NO: 1) or 400 bp modified TNNT2 (SEQ ID NO: 3) promoter operatively linked to a polynucleotide that encodes MYBPC3. Tissue samples from heart, skeletal muscle (tibialis anterior), liver and whole brain were harvested 2 weeks post-infection. RNA was extracted from all tissues, synthesized to cDNA and analyzed by qRT-PCR using primers specific to human MYBPC3.

Figure 5:
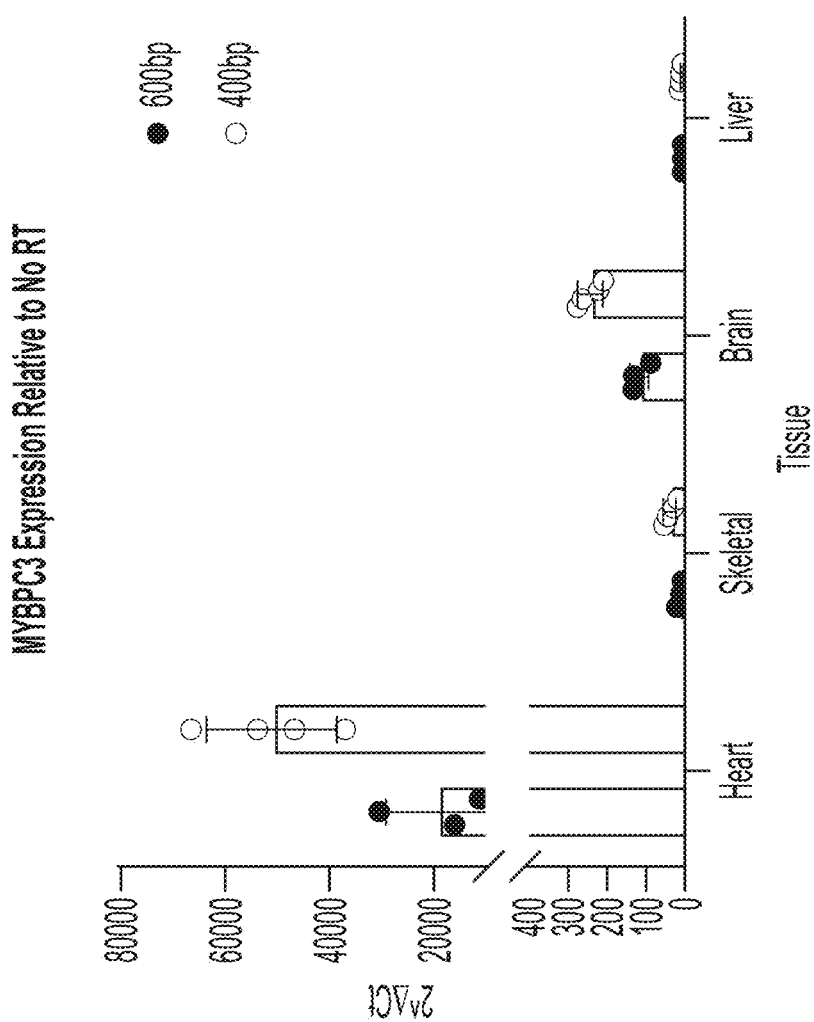
FIG. 5 shows detection of MYBPC3 mRNA by qRT-PCR in heart, skeletal, brain and liver tissue harvested from mice retro-orbitally injected with E12 GC AAV9-packaged constructs encoding human MYBPC3 driven by various sizes (400 or 600 bp) of the human cardiac TNNT2 promoter.

As shown in FIG. 5, mice injected with the AAV9-based vector comprising either the wild-type or modified TNNT2 promoter showed high levels of MYBPC3 mRNA in heart tissue compared to skeletal, brain or liver tissue. The 400 bp modified TNNT2 promoter showed increased expression of MYBPC3 mRNA in heart tissue compared to the 600 bp wild-type TNNT2 promoter.

Figure 6B:
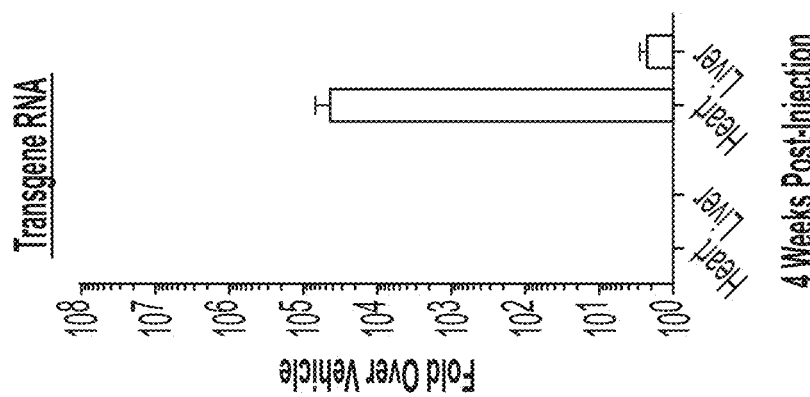
FIG. 6B shows a bar graph showing fold increase over vehicle of transgene RNA in the heart and liver of adult mice 4 weeks after intravenous administration with an AAV9 vector containing the 400 bp modified TNNT2 promoter cassette.
Figure 6A:
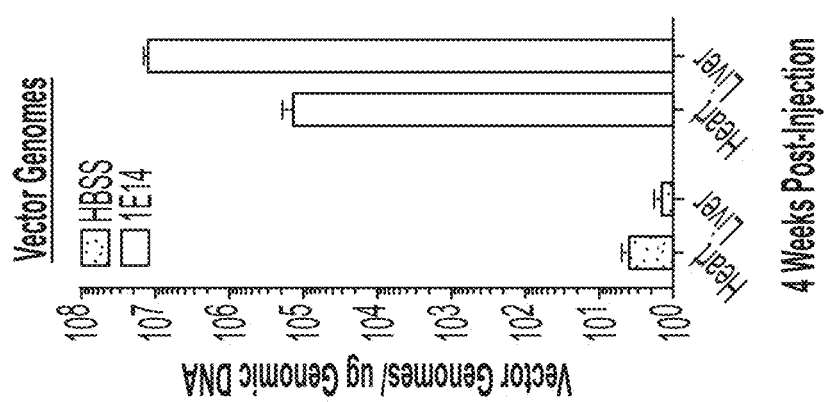
FIG. 6A shows a bar graph showing absolute quantification of vector genomes per microgram of genomic DNA in the heart and liver of adult mice 4 weeks after intravenous administration with an AAV9 vector containing the 400 bp modified TNNT2 promoter cassette.

As shown in FIGS. 6A-6B, adult mice were intravenously dosed via tail vein injection with an AAV9 vector with the 400 bp modified TNNT2 promoter cassette. Tissue samples from heart and liver were harvested 4 weeks post-injection. Absolute quantification of viral genomes per microgram of genomic DNA was assessed by qPCR using linearized standards. RNA was extracted from all tissues, synthesized to cDNA and analyzed by qRT-PCR using primers specific to human MYBPC3. Surprisingly, the 400 bp TNNT2 promoter retains high selectivity for the heart: despite the 100-fold greater vector genomes detected in the liver than the heart 4 weeks post-injection in the adult-dosed animals (FIG. 6A, logarithmic scale), liver expression of the transgene was less than 1/10,000th of cardiac expression (FIG. 6B, logarithmic scale).

Collectively, these results indicate that a 200 bp deletion from the wild-type TNNT2 promoter, i.e., the 400 bp modified TNNT2 promoter (SEQ ID NO: 3), effectively drives expression of MYBPC3 protein in cardiomyocytes with high selectivity despite deletion of a substantial portion of the promoter sequence.

Example 5: Rescue of Cardiac Function in Mybpc3 Null Mice

This example demonstrates functional rescue of loss of function in the Mybpc3 in mice, using the vector designed for large cargoes described in Example 1 and the 400 bp modified hTNNT2 promoter described in Examples 2 and 3.

The 400 bp hTNNT2 promoter and murine Mybpc3 gene were cloned into the vector shown in FIG. 1C. This vector was packaged using an AAV9 capsid to generate the test vector.

Figure 7:
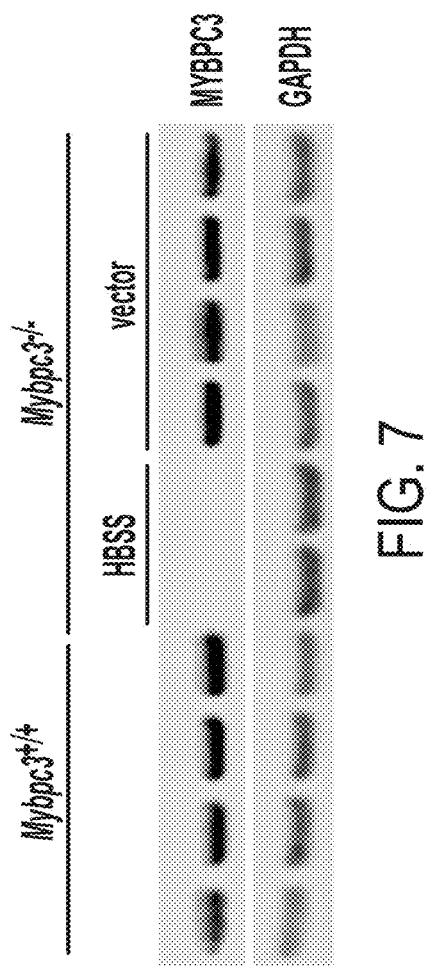
FIG. 7 shows a western blot of MYBPC3 protein expression in homozygous Mybpc3$^{-/-}$ mice injected retro-orbitally at two weeks of age with 1E14 vg·kg$^{-1}$ test vector encoding Mybpc3 or vehicle, HBSS.
Figure 8:
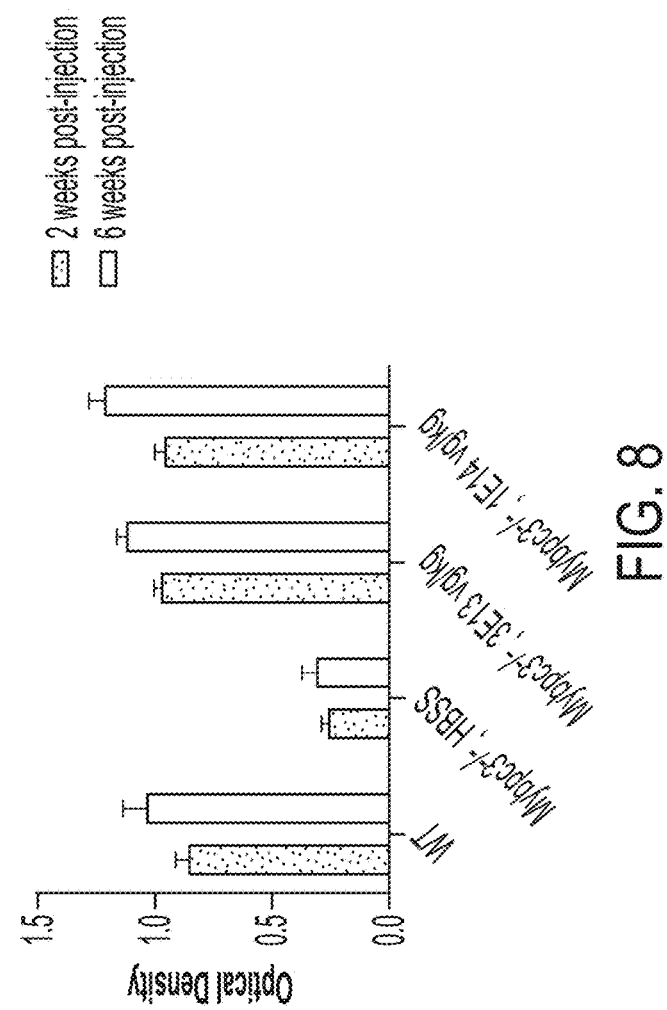
FIG. 8 shows a bar graph showing MYBPC3 expression in homozygous Mybpc3$^{-/-}$ mice injected retro-orbitally at two weeks of age 3E13 vg·kg$^{-1}$ and 1E14 vg·kg$^{-1}$ test vector encoding Mybpc3 or vehicle, HBSS.

In a first experiment, homozygous Mybpc3$^{-/-}$ mice were injected retro-orbitally at two weeks of age with 1E14 vg·kg$^{-1}$ test vector encoding Mybpc3 or vehicle, HBSS. Cardiac tissue was harvested two weeks later (at four weeks), along with that of wild-type littermates. The experimental vector achieved wild-type levels of MYBPC3 protein expression in Mybpc3$^{-/-}$ mice at two weeks post-injection (FIG. 7). We conclude the test vector was capable of expressing MYBPC3 at physiological levels in juvenile animals at a dose as low as 1E14 vg·kg$^{-1}$ In a second experiment, the first experiment was repeated at a lower dose, 3E13 vg·kg$^{-1}$. Homozygous Mybpc3$^{-/-}$ mice were injected retro-orbitally at two weeks of age with 3E13 vg·kg$^{-1}$ and 1E14 vg·kg$^{-1}$ test vector encoding Mybpc3 or vehicle, HBSS. Wild-type levels of cardiac MYBPC3 protein expression were detected by ELISA in Mybpc3$^{-/-}$ mice at two and six weeks post-injection (FIG. 8) We conclude the test vector was capable of expressing MYBPC3 at physiological levels in juvenile animals at a dose as low as 3E13 vg·kg$^{-1}$ In a third experiment, cardiac function was assessed using assays relevant to hypertrophic cardiomyopathy. Hypertrophic cardiomyopathy presents physiologically as (1) an increase in heart size, measured as reported as the ratio of left ventricular mass/total body mass (LVM/BW) in mg·g$^{-1}$; and (2) as fractional shortening (FAS), measured by echocardiography.

Figure 9A:
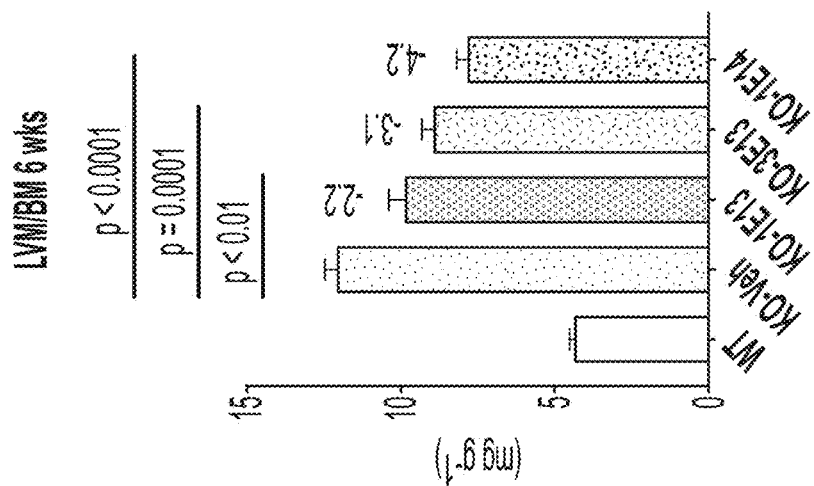
FIG. 9A shows a bar graph showing left ventricular mass normalized to body weight (LVM/BM) in homozygous Mybpc3$^{-/-}$ mice 6 weeks after they were injected retro-orbitally at two weeks of age with 1E13 vg·kg-1, 3E13 vg·kg$^{-1}$, and 1E14 vg·kg$^{-1}$ of test vector encoding Mybpc3 or vehicle, HBSS.
Figure 9B:
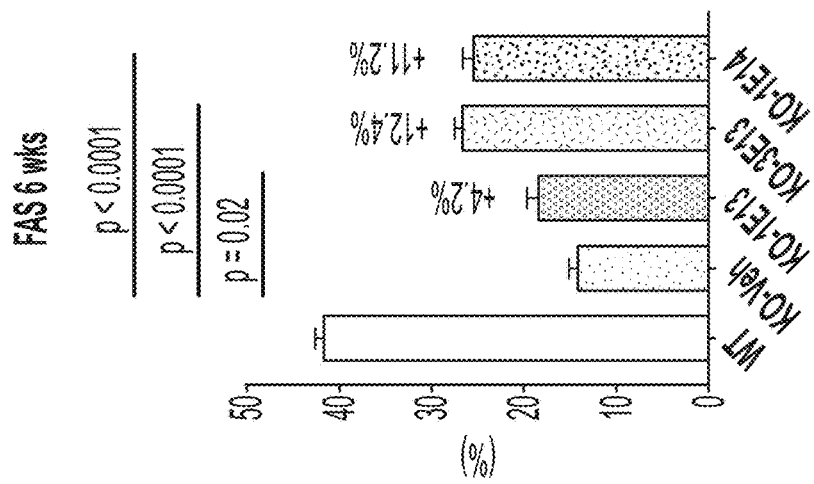
FIG. 9B shows a bar graph showing FAS expressed as % percentage change in LV internal dimensions between systole and diastole in homozygous Mybpc3$^{-/-}$ mice 6 weeks after they were injected retro-orbitally at two weeks of age with 1E13 vg·kg$^{-1}$, 3E13 vg·kg$^{-1}$, and 1E14 vg·kg-1 of test vector encoding Mybpc3 or vehicle, HBSS.
Figure 9C:
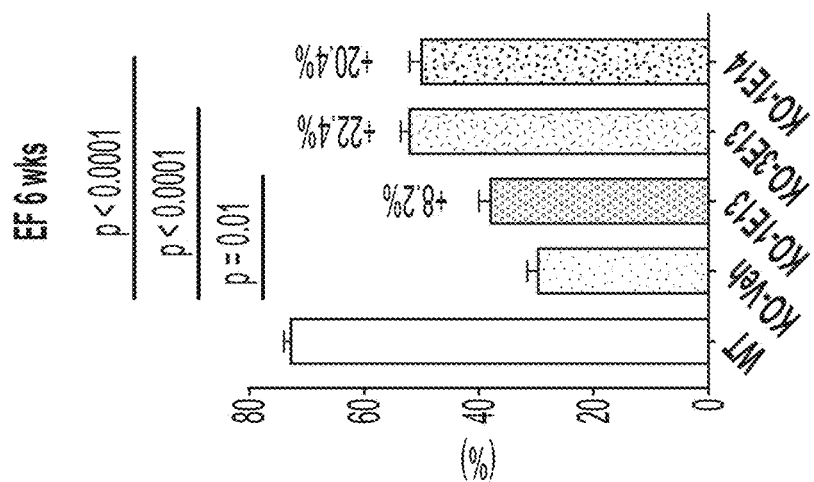
FIG. 9C shows a bar graph showing ejection fraction in homozygous Mybpc3$^{-/-}$ mice 6 weeks after they were injected retro-orbitally at two weeks of age with 1E13 vg·kg$^{-1}$, 3E13 vg·kg$^{-1}$, and 1E14 vg·kg-1 of test vector encoding Mybpc3 or vehicle, HBSS.
Figure 9F:
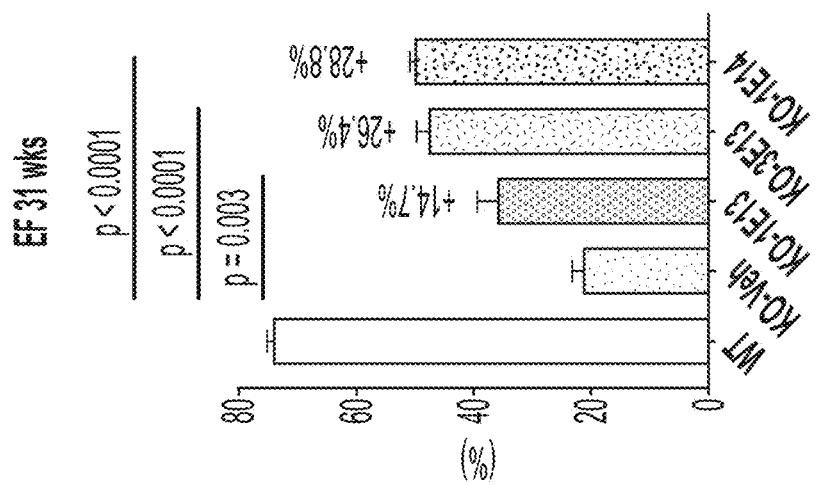
FIG. 9F shows a bar graph showing ejection fraction in homozygous Mybpc3$^{-/-}$ mice 31 weeks after they were injected retro-orbitally at two weeks of age with 1E13 vg·kg$^{-1}$, 3E13 vg·kg$^{-1}$, and 1E14 vg·kg$^{-1}$ of test vector encoding Mybpc3 or vehicle, HBSS.
Figure 9E:
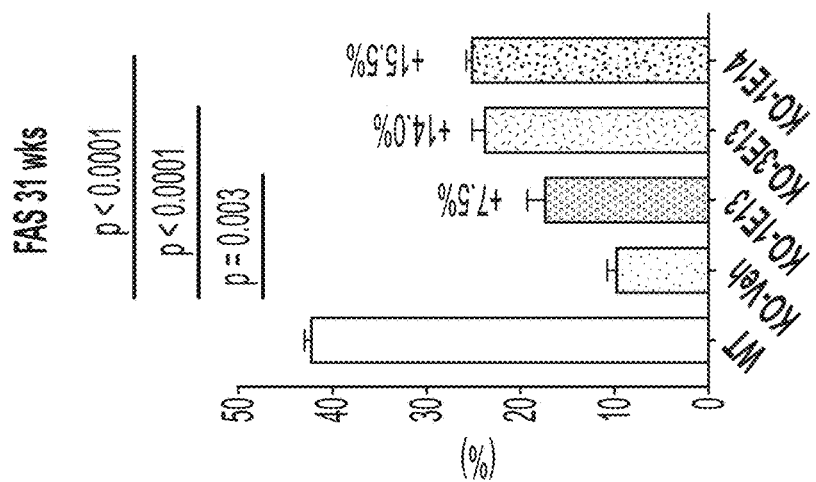
FIG. 9E shows a bar graph showing FAS expressed as % percentage change in LV internal dimensions between systole and diastole in homozygous Mybpc3$^{-/-}$ mice 31 weeks after they were injected retro-orbitally at two weeks of age with 1E13 vg·kg$^{-1}$, 3E13 vg·kg$^{-1}$, and 1E14 vg·kg$^{-1}$ of test vector encoding Mybpc3 or vehicle, HBSS.
Figure 9D:
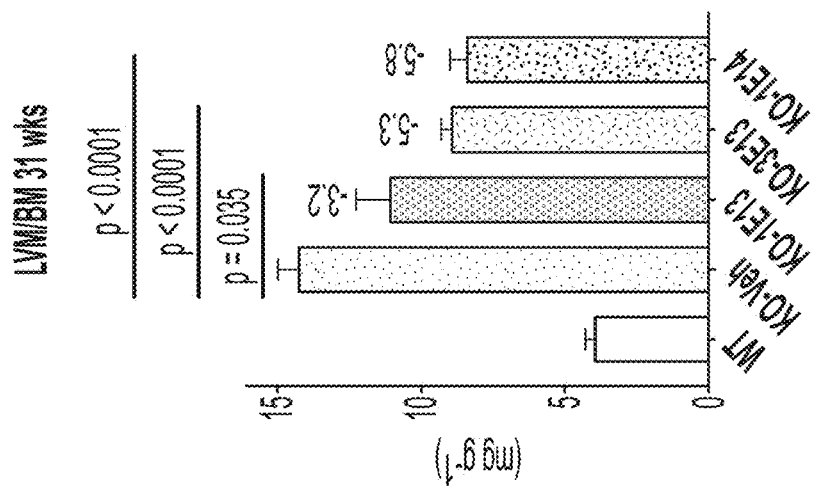
FIG. 9D shows a bar graph showing left ventricular mass normalized to body weight (LVM/BM) in homozygous Mybpc3$^{-/-}$ mice 31 weeks after they were injected retro-orbitally at two weeks of age with 1E13 vg·kg-1, 3E13 vg·kg$^{-1}$, and 1E14 vg·kg$^{-1}$ of test vector encoding Mybpc3 or vehicle, HBSS.

Homozygous Mybpc3$^{-/-}$ mice were injected retro-orbitally at two weeks of age with 1E13 vg·kg$^{-1}$, 3E13 vg·kg$^{-1}$, and 1E14 vg·kg$^{-1}$ of test vector encoding Mybpc3 or vehicle, HBSS. Dose-dependent rescue of cardiac function was observed at all tested doses (1E13 vg·kg$^{-1}$, 3E13 vg·kg$^{-1}$, and 1E14 vg·kg). LVM/BM was decreased from vehicle control at all tested doses six weeks post-injection (FIG. 9A). FAS (expressed as % percentage change in LV internal dimensions between systole and diastole, FIG. 9B) and ejection fraction (FIG. 9C) were increased from vehicle control at all tested doses six weeks post-injection. Even greater improvements in LVM/BM (FIG. 9D), FAS (FIG. 9E), and EF (FIG. 9F) were observed 31 weeks following injection. Consistent with equal levels of MYBPC3 protein expression observed at 3E13 vg·kg$^{-1}$ and 1E14 vg·kg$^{-1}$ doses (see FIG. 8), animals treated with 3E13 vg·kg$^{-1}$ or 1E14 vg·kg$^{-1}$ exhibit similar improvements in hypertrophy, FAS or EF improvements. Even at only 1E13 vg·kg$^{-1}$ dose, hypertrophy, FAS and EF are all improved compared to vehicle control.

We conclude the test vector was capable of rescue of cardiac function in juvenile animals at a dose as low as 1E13 vg·kg$^{-1}$.

Rescue of function in symptomatic juvenile mice is, in the case of hypertrophic cardiomyopathy, more challenging than prevention of decline in function in infants, because hypertrophic cardiomyopathy is a progressive disorder. Older animals exhibit more severe disease than younger animals. To our knowledge, rescue of MYBPC3 loss of function in symptomatic juvenile animals has never been demonstrated before with AAV. Our model is also a complete loss of function caused by deletion of the Mybpc3 gene, not a partial loss of function due to mutation.

We compared our results to those reported in Mearini et al., *Nat. Commun.* 5:5515 (2014), which used a 5.4 kb expression cassette encoding Mybpc3 in mice having a single nucleotide polymorphism in the endogenous Mybpc3 gene. Mearni et al. report prevention of high LVM/BW at two-weeks of age in mice injected as neonates (not symptomatic juveniles) with very high doses (1E12 vg and 3E12 vg, which corresponds to 7E14 vg·kg$^{-1}$ and 2E15 vg·kg$^{-1}$, based on an average neonate mass of 1.5 g) of an AAV9 vector encoding the same Mybpc3 gene. Mearni et al. used a 550 bp hTNNT2 promoter, rather than the present 400 bp modified hTNNT2 promoter. The vector Mearini et al. does not significantly prevent FAS decline, even at 2E15 vg·kg$^{-1}$. By contrast, the present vector demonstrates improvement in physiological parameters in juveniles animals (not only neonates) at doses at least as low as 1E13 vg·kg$^{-1}$ to 1E14 vg·kg$^{-1}$.

The vector and promoter modifications dramatically and surprisingly increase potency of the vector.

Example 6: Direct Comparison of 5.4 Kbp Cassette to 4.7 Kbp Cassette

This example directly compares a 5.4 kbp cassette encoding the Mybpc3 gene to a 4.7 kbp cassette encoding the Mybpc3 gene in mature (2.5 months of age) homozygous mice with advanced disease.

Homozygous Mybpc3$^{-/-}$ mice were injected retro-orbitally with 3E13 vg·kg$^{-1}$ or 1E14 vg·kg$^{-1}$ of AAV9 vector encoding Mybpc3 in the context of the 5.4 kbp or 4.7 kbp cassettes (FIG. 10A), or injected with vehicle control, HBSS. Even when dosed at this advanced stage of cardiac decline, the 4.7 kbp cassette significantly improved cardiac function based on ejection fraction (EF) (FIG. 10B), with clear restoration of function above pre-dose baseline (FIG. 10C), unlike animals treated with vehicle (Veh) or the 5.4 kbp cassette. Further, compared to the 5.4 kbp cassette, the 4.7 kbp cassette was also able to significantly decrease hypertrophy, as indicated by LVM/BM, eighteen weeks post-injection (FIG. 10D).

This example demonstrates functional rescue of loss of function in the Mybpc3 in mice, using the vector backbone and promoter modifications described in Examples 1-3.

This example also demonstrates that, in a challenging model of disease—adult, homozygous Mybpc3$^{-/-}$ mice—a 5.4 kbp vector (SEQ ID NO: 201) at low dose fails to generate any physiological improvement; whereas a 4.7 kbp vector according to the present disclosure causes statistically significant improvement in physiological parameters related to cardiomyopathy at doses as low as 3E13 vg·kg$^{-1}$.

Example 7: Greater Efficacy with an Improved AAV Capsid Encoding MYBPC3

This example demonstrates how the improved potency of the large cargo vector (Example 1) and modified promoter (Examples 2 and 3) based on rescue of Mybpc3$^{-/-}$ mice (Example 5) can be further improved by use of an engineered AAV capsid.

An AAV9 capsid variant, CR9-10 exhibited significantly higher cardiac transduction upon systemic delivery in adult mice than AAV9 with a GFP-encoding cassette as determined by ELISA (p <0.05, One-way ANOVA; Dunnett's multiple comparison test) (FIG. 11A).

In a second experiment, the expression cassette encoding the murine Mybpc3 gene was packaged into either AAV9 or CR9-10 and the potency of cardiac rescue in Mybpc3$^{-/-}$ mice compared. Homozygous Mybpc3$^{-/-}$ mice were injected retro-orbitally at two weeks of age with 1E13 vg·kg$^{-1}$ and 3E13 vg·kg$^{-1}$ of AAV9 vector, CR9-10 vector, or vehicle control HBSS. All test articles significantly improved cardiac function based on ejection fraction (EF) (FIG. 11B), with clear restoration of function above pre-dose baseline (AEF) (FIG. 11C). Consistent with improved cardiac transduction, CR9-10 resulted in greater EF improvement than AAV9.

Example 8: Non-Human Primate Study of Engineered AAV Capsid Variants

Biodistribution of AAV vectors having engineered capsids (described in U.S. Provisional Patent Appl. No. 63/012,703, which is incorporated herein in its entirety), were assessed in male cynomolgus macaques (*Macaca fascicularis*) following intravenous delivery.

AAV vector generated with fourteen different capsids, including AAV9, were pooled and injected into NHPs at a 1E13 vg·kg-1 dose (n=3). Viral DNA was extracted from left ventricle and liver one month after systemic delivery. Consistent with the murine results, CR9-10 exhibited increased cardiac transduction compared to AAV9 (FIG. 12A). Additionally, many variants decreased liver viral burden relative to AAV9 (FIG. 12B), improving the ratio of left ventricle transduction to liver infection (FIG. 12C).

Example 10: Rescue of Cardiac Function with the Human MYBPC3 Gene in Mybpc3 Null Mice This example demonstrates the ability of human MYBPC3 gene to rescue Mybpc3$^{-/-}$ mice.

Homozygous Mybpc3$^{-/-}$ mice were injected retro-orbitally at two weeks of age with AAV9 encoding the mouse Mybpc3 gene (mMybpc3) (at 1E14 vg·kg-1), AAV9 encoding the human MYBPC3 gene (hMYBPC3) (at 1E14 vg·kg-1), or vehicle, HBSS. Cardiac size and function were monitored by echocardiography up to eight months post-injection. The results indicate that AAV9-mediated cardiac MYBPC3 replacement of either mMybpc3 and hMYBPC3 in Mybpc3$^{-/-}$ mice resulted in recovery of cardiac size and function. Ejection fraction (EF) was significantly improved by both the human and mouse orthologs of MYBPC3, with mMybpc3 yielding greater improvement in EF compared to hMYBPC3 (FIG. 13A). Importantly, hMYBPC3 was just as potent as mMybpc3 at reducing cardiac hypertrophy over time, as evidenced by left ventricular mass normalized to body weight (LVM/BW) (FIG. 13B). This was further validated by comparable decreases in left ventricular posterior wall thickness during diastole (LVPW;d) (FIG. 13C). Critically, all improvements exhibited robust stability out to 8 months post-injection.

In a second study, the efficacy of hMYBPC3 was assessed over a range of viral doses. Homozygous Mybpc3$^{-/-}$ mice were injected retro-orbitally at two weeks of age with 1E13 vg·kg-1, 1E14 vg·kg-1, and 3E14 vg·kg-1 of test vector encoding the human MYBPC3 gene or vehicle, HBSS. Dose-dependent improvement of cardiac function was observed for all tested doses (1E13 vg·kg-1, 1E14 vg·kg-1, and 3E14 vg·kg-1) fourteen weeks post-injection, as indicated by EF (FIG. 14A), with significant improvement above pre-dose baseline for 1E14 vg·kg-1 and 3E14 vg·kg-1 treatments (FIG. 14B). Significant reduction in cardiac hypertrophy was also observed for 1E14 vg·kg-1 and 3E14 vg·kg-1 treatments, based on LVM/BW (FIG. 14C). Thus, we conclude the hMYBPC3 test vector was capable of preserving cardiac function in adult animals at a dose as low as 1E13 vg·kg-1.

Example 11: Treatment of Hypertrophic Cardiomyopathy (HCM)

Cardiomyopathy is the number-one cause of sudden cardiac arrest in children under 18. Hypertrophic cardiomyopathy (HCM) affects 0.5 million Americans, potentially resulting in heart failure or sudden death. Loss-of-function mutations in Myosin Binding Protein C3, MYBPC3, are the most common genetic cause of HCM. The majority of MYBPC3 mutations causative for HCM result in truncations, via nonsense, frameshift or splice-site mutations. The sarcomeric pathophysiology of the majority of HCM patients with MYBPC3 mutations appears to be due to haploinsufficiency, as the total amount of MYBPC3 protein incorporated into sarcomeres falls significantly below normal. Decreased sarcomeric levels of MYBPC3 result in decreased myosin inhibition with more myosin heads engaged on the actin filament, resulting in hypercontractility.

The clearest path to the treatment of haploinsufficiency is the restoration of the insufficient gene product; in this case wild-type MYBPC3. Thus, we have successfully engineered an AAV vector (TN-201) with superior properties for selective restoration of MYBPC3 to cardiomyocytes upon systemic delivery. Critically, we have demonstrated for the first time with AAV the ability of both a mouse surrogate and TN-201 to reverse cardiac dysfunction and hypertrophy in a symptomatic murine model of disease.

Dose-ranging efficacy studies exhibited restoration of wild-type MYBPC3 protein levels and saturation of cardiac improvement at the clinically relevant dose of 3E13 vg/kg. Further, pilot safety studies in adult and infant mice injected with >10× an efficacious dose exhibited no clinical observations, no alterations in cardiac function, and no histopathological findings. Importantly, we have determined that TN-201 produced utilizing the highly scalable Sf9 platform results in similarly potent efficacy in a Mybpc3$^{-/-}$ model of disease. Finally, we have established that our observed efficacy is sufficiently meaningful for stable benefit up to 8 months post-injection, as well as reversal of cardiac dysfunction even in late-stage homozygote disease.

Example 12: Clinical Studies

A pharmaceutical composition comprising rAAV virions encoding MYBPC3, as described herein, is administered by intravenously or by retrograde coronary sinus (RCSI). Functional efficacy is determined by cardiac functional status assessments (e.g., New York Heart Association Functional Classification, NYHA; Cardiopulmonary exercise test, CPET), quality of life questionnaires (e.g., Kansas City Cardiomyopathy Questionnaire Clinical Quality Score, KCCQ-CSS), cardiac imaging (e.g., echocardiography), cardiac biomarkers (e.g. troponin and NT-proBNP), cardiac rhythm and immunologic assessments, cardiac functional status assessments (e.g., Pediatric Interagency Registry for Mechanically Assisted Circulatory Support, PEDIMACS; Ross classifications), and/or Major Adverse Cardiac Events (MACE) (total death, cardiac transplantation, initiation of inotropes, initiation of ventilatory, or mechanical circulatory support). Clinical studies may include monitoring safety and continued efficacy (e.g., adverse events, severe adverse events, electrocardiogram, cardiac enzymes, biomarkers, functional status, left ventricular (LV) function/mass, quality of life, serum chemistries, liver function tests) on an annual basis for up to 10 years.

SEQUENCE LISTING (201 sequences)

SEQ ID NO: 1 - DNA, 600 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 2 - DNA, 500 bp, Homo sapiens
gatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 3 - DNA, 400 bp, Homo sapiens
gttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 4 - DNA, 300 bp, Homo sapiens
gttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 5 - DNA, 590 bp, Homo sapiens
agacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 6 - DNA, 580 bp, Homo sapiens
tgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 7 - DNA, 570 bp, Homo sapiens
ctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 8 - DNA, 560 bp, Homo sapiens
ctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 9 - DNA, 550 bp, Homo sapiens
cggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 10 - DNA, 540 bp, Homo sapiens
cctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 11 - DNA, 530 bp, Homo sapiens
ctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 12 - DNA, 520 bp, Homo sapiens
taggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 13 - DNA, 510 bp, Homo sapiens
tagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 14 - DNA, 490 bp, Homo sapiens
cccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 15 - DNA, 480 bp, Homo sapiens
cagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 16 - DNA, 470 bp, Homo sapiens
ggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 17 - DNA, 460 bp, Homo sapiens
ataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 18 - DNA, 450 bp, Homo sapiens
ccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 19 - DNA, 440 bp, Homo sapiens
tccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 20 - DNA, 430 bp, Homo sapiens
tggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 21 - DNA, 420 bp, Homo sapiens
acttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 22 - DNA, 410 bp, Homo sapiens
tgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 23 - DNA, 390 bp, Homo sapiens
gccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 24 - DNA, 380 bp, Homo sapiens
cctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 25 - DNA, 370 bp, Homo sapiens
gctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 26 - DNA, 360 bp, Homo sapiens
ccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 27 - DNA, 350 bp, Homo sapiens
gttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 28 - DNA, 340 bp, Homo sapiens
tctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 29 - DNA, 330 bp, Homo sapiens
caggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 30 - DNA, 320 bp, Homo sapiens
aagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 31 - DNA, 310 bp, Homo sapiens
gctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 32 - DNA, 290 bp, Homo sapiens
tgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 33 - DNA, 280 bp, Homo sapiens
atatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 34 - DNA, 270 bp, Homo sapiens
tggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 35 - DNA, 260 bp, Homo sapiens
tagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 36 - DNA, 250 bp, Homo sapiens
gagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 37 - DNA, 240 bp, Homo sapiens
aggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 38 - DNA, 230 bp, Homo sapiens
gggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 39 - DNA, 220 bp, Homo sapiens
ggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 40 - DNA, 210 bp, Homo sapiens
acatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 41 - DNA, 200 bp, Homo sapiens
gtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctcca

SEQ ID NO: 42 - DNA, 550 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 43 - DNA, 540 bp, Homo sapiens
agacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 44 - DNA, 530 bp, Homo sapiens
tgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 45 - DNA, 520 bp, Homo sapiens
ctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 46 - DNA, 510 bp, Homo sapiens
ctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 47 - DNA, 500 bp, Homo sapiens
cggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 48 - DNA, 490 bp, Homo sapiens
cctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 49 - DNA, 480 bp, Homo sapiens
ctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 50 - DNA, 470 bp, Homo sapiens
taggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 51 - DNA, 460 bp, Homo sapiens
tagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 52 - DNA, 450 bp, Homo sapiens
gatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 53 - DNA, 440 bp, Homo sapiens
cccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 54 - DNA, 430 bp, Homo sapiens
cagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 55 - DNA, 420 bp, Homo sapiens
ggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 56 - DNA, 410 bp, Homo sapiens
ataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 57 - DNA, 400 bp, Homo sapiens
ccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 58 - DNA, 390 bp, Homo sapiens
tccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 59 - DNA, 380 bp, Homo sapiens
tggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 60 - DNA, 370 bp, Homo sapiens
acttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 61 - DNA, 360 bp, Homo sapiens
tgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 62 - DNA, 350 bp, Homo sapiens
gttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 63 - DNA, 340 bp, Homo sapiens
gccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 64 - DNA, 330 bp, Homo sapiens
cctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 65 - DNA, 320 bp, Homo sapiens
gctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 66 - DNA, 310 bp, Homo sapiens
ccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 67 - DNA, 300 bp, Homo sapiens
gttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 68 - DNA, 290 bp, Homo sapiens
tctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 69 - DNA, 280 bp, Homo sapiens
caggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 70 - DNA, 270 bp, Homo sapiens
aagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 71 - DNA, 260 bp, Homo sapiens
gctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 72 - DNA, 250 bp, Homo sapiens
gttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 73 - DNA, 240 bp, Homo sapiens
tgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 74 - DNA, 230 bp, Homo sapiens
atatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 75 - DNA, 220 bp, Homo sapiens
tggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 76 - DNA, 210 bp, Homo sapiens
tagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 77 - DNA, 200 bp, Homo sapiens
gagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctc

SEQ ID NO: 78 - DNA, 550 bp, Homo sapiens; identical to SEQ ID NO: 42

SEQ ID NO: 79 - DNA, 500 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctc

SEQ ID NO: 80 - DNA, 450 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccaccc

SEQ ID NO: 81 - DNA, 400 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcct

SEQ ID NO: 82 - DNA, 350 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatct

SEQ ID NO: 83 - DNA, 300 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttat

SEQ ID NO: 84 - DNA, 250 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgg

SEQ ID NO: 85 - DNA, 200 bp, Homo sapiens
gtcatggagaagacccaccttgcagatgtcctcactggggctggcagagccggcaacctgcctaaggctgctcagtccattaggagccagtagcctggaagatgtctttacccccagcatcagttcaagtggagcagcacataactcttgccctctgccttccaagattctggtgctgagacttatggagtgtcttggag

SEQ ID NO: 86 - DNA, 3825 bp, Homo sapiens
atgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaa

SEQ ID NO: 87 - DNA, 3546 bp, Homo sapiens
atgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaa

SEQ ID NO: 88 - DNA, 3534 bp, Homo sapiens
atgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggagcctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaa

SEQ ID NO: 89 - DNA, 3546 bp, Homo sapiens
atgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggagcccaggcaggaacctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaa

SEQ ID NO: 90 - DNA, 1156 bp, Homo sapiens
agtccccgctgagactgagcagacgcctccaggatctgtcggcagctgctgttctgagggagagcagagaccatgtctgacatagaagaggtggtggaagagtacgaggaggaggagcaggaagaagcagctgttgaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 91 - skipped

SEQ ID NO: 92 - DNA, 49 bp, Artificial Sequence
  pCard1 polyA signal
aataaaagatctttattttcattagatctgtgtgttggttttttgtgtg

SEQ ID NO: 93 - DNA, 480 bp, Artificial Sequence
  pCard1 5' segment
tgtagttaatgattaacccgccatgctacttatctacgtagccatgctctaggaagatcggaattcgcccttaagttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccacc

SEQ ID NO: 94 - DNA, 148 bp, Artificial Sequence
  pCard1 3' segment
agcttaataaaagatctttattttcattagatctgtgtgttggttttttgtgtgctggggactcgagttaagggcgaattcccgataaggatcttcctagagcatggctacgtagataagtagcatggcgggttaatcattaactaca

SEQ ID NO: 95 - DNA, 4453 bp, Artificial Sequence
  pCard1 with MYBPC3 no ITR
tgtagttaatgattaacccgccatgctacttatctacgtagccatgctctaggaagatcggaattcgcccttaagttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaaagcttaataaaagatctttattttcattagatctgtgtgttggttttttgtgtgctggggactcgagttaagggcgaattcccgataaggatcttcctagagcatggctacgtagataagtagcatggcgggttaatcattaactaca

SEQ ID NO: 96 - DNA, 130 bp, Artificial Sequence
  5' ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 97 - DNA, 130 bp, Artificial Sequence
  3' ITR
aggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 98 - DNA, 1089 bp, Artificial Sequence
  pCard0 viral genome
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagtcatggagaagacccaccttgcagatgtcctcactggggctggcagagccggcaacctgcccaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccaagcttaataaaagatctttattttcattagatctgtgtgttggttttttgtgtgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 99 - DNA, 830 bp, Artificial Sequence
  pCard0 expression cassette
tgtagttaatgattaacccgccatgctacttatctacgtagccatgctctaggaagatcggaattcgcccttaagtcatggagaagacccaccttgcagatgtcctcactggggctggcagagccggcaacctgcccaaggctgctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccaagcttaataaaagatctttattttcattagatctgtgtgttggttttttgtgtgctggggactcgagttaagggcgaattcccgataaggatcttcctagagcatggctacgtagataagtagcatggcgggttaatcattaactacaa

SEQ ID NO: 100 - DNA, 889 bp, Artificial Sequence
  pCard1 viral genome
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccaagcttaataaaagatctttattttcattagatctgtgtgttggttttttgtgtgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 101 - DNA, 629 bp, Artificial Sequence
  pCard1 expression cassette
tgtagttaatgattaacccgccatgctacttatctacgtagccatgctctaggaagatcggaattcgcccttaagttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccaagcttaataaaagatctttattttcattagatctgtgtgttggttttttgtgtgctggggactcgagttaagggcgaattcccgataaggatcttcctagagcatggctacgtagataagtagcatggcgggttaatcattaactaca

SEQ ID NO: 102 - DNA, 4713 bp, Artificial Sequence
  pCard1 viral genome with MYBPC3
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccagccaccatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccccgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggaactctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtaaagcttaataaaagatctttattttcattagatctgtgtgttggttttttgtgtgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 103 - protein, 1274 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 104 - protein, 1181 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 105 - protein, 1177 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 106 - protein, 1181 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 107 - DNA, 3480 bp, Homo sapiens
atgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttag

SEQ ID NO: 108 - protein, 1159 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 109 - DNA, 3645 bp, Homo sapiens
atggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactga

SEQ ID NO: 110 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 111 - DNA, 3357 bp, Homo sapiens
atggcgcggagcccgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaa

SEQ ID NO: 112 - protein, 1118 aa, Homo sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 113 - DNA, 2994 bp, Homo sapiens
atggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaa

SEQ ID NO: 114 - protein, 997 aa, Homo sapiens
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 115 - DNA, 6666 bp, Homo sapiens
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtag

SEQ ID NO: 116 - protein, 2221 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 117 - DNA, 1869 bp, Homo sapiens
atgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataa

SEQ ID NO: 118 - protein, 622 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 119 - DNA, 1920 bp, Homo sapiens
atgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctga

SEQ ID NO: 120 - protein, 639 aa, Homo sapiens
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 121 - DNA, 7740 bp, Homo sapiens
atggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatag

SEQ ID NO: 122 - protein, 2579 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 123 - DNA, 2979 bp, Homo sapiens
atggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaactataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtag

SEQ ID NO: 124 - protein, 992 aa, Homo sapiens
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 125 - DNA, 3687 bp, Homo sapiens
atgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactag

SEQ ID NO: 126 - protein, 1228 aa, Homo sapiens
MIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 127 - DNA, 8616 bp, Homo sapiens
atgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaa

SEQ ID NO: 128 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 129 - DNA, 8520 bp, Homo sapiens
atggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttccattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtga

SEQ ID NO: 130 - protein, 2839 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 131 - DNA, 6051 bp, Homo sapiens
atggcaaacttcctattacctcggggcaccagcagcttccgcaggttcacacgggagtccctggcagccatcgagaagcgcatggcagagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtga

SEQ ID NO: 132 - protein, 2016 aa, Homo sapiens [sequence omitted]

SEQ ID NO: 133 - DNA, 4002 bp, Homo sapiens
atgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 134 - protein, 1333 aa, Homo sapiens [sequence omitted]

SEQ ID NO: 135 - DNA, 3186 bp, Homo sapiens
atgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctga

SEQ ID NO: 136 - protein, 1061 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 137 - DNA, 3927 bp, Homo sapiens
atgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaa

SEQ ID NO: 138 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 139 - DNA, 510 bp, Homo sapiens
atggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatga

SEQ ID NO: 140 - protein, 169 aa, Homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 141 - DNA, 5808 bp, Homo sapiens
atgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgaaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagttgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggcgtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggctaaggtgaaggagatgaacgagaggctggaggatgaggaggagatgaatgctgagctcactgccaagaagcgcaagttggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggagtccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtag

SEQ ID NO: 142 - protein, 1935 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELESERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 143 - protein, 736 aa, Dependoparvovirus Adeno-associated virus serotype 9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 144 - protein, 724 aa, Dependoparvovirus Adeno-associated virus serotype 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 145 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISQVNGRPRDLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 146 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 147 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVSYQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 148 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSMVNQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 149 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 150 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVGTQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 151 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVSYQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 152 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 153 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNQDASLLWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 154 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNGMSFTWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 155 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 156 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNQDASLLWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 157 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNGMSFTWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 158 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 159 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTNNYNDPQFVDFAPDSTGEYRTTRPIGTRYLTRPL

SEQ ID NO: 160 - protein, 725 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTSNYYKSNNVEFAVNTEGVYSEPRPIGTRYLTRNL

SEQ ID NO: 161 - protein, 725 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEAAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 162 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 163 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVTVEMEWELKKENSKRWNPEIQYTNNYNDPQFVDFAPDSTGEYRTTRPIGTRYLTRPL

SEQ ID NO: 164 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSFAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 165 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 166 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTNNYNDPQFVDFAPDSTGEYRTTRPIGTRYLTRPL

SEQ ID NO: 167 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVTVEMEWELKKENSKRWNPEIQYTSNYYKSNNVEFAVNTEGVYSEPRPIGTRYLTRNL

SEQ ID NO: 168 - protein, 726 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 169 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 170 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGNASGDWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSKMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVTVEMEWELKKENSKRWNPEIQYTNNYNDPQFVDFAPDSTGEYRTTRPIGTRYLTRNL

SEQ ID NO: 171 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTNNYNDPQFVDFAPDSTGEYRTTRPIGTRYLTRPL

SEQ ID NO: 172 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 173 - protein, 726 aa, Artificial Sequence; identical to SEQ ID NO: 169
  Recombinant AAV Capsid Protein

SEQ ID NO: 174 - protein, 726 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 175 - protein, 726 aa, Artificial Sequence
  Recombinant AAV Capsid Protein
MSFVDHPPDWLEEVGEGLREFLGLEAGPPKPKPNQQHQDQARGLVLPGYKYLGPGNGLDKGEPVNAADAAALEHDKAYDQQLKAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 176 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 177 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 178 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 179 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 180 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQEKLADDTSFGGNLGKAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 181 - protein, 736 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 182 - protein, 735 aa, Artificial Sequence; identical to SEQ ID NO: 171
  Recombinant AAV Capsid Protein

SEQ ID NO: 183 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 184 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 185 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVSYQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 186 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 187 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 188 - protein, 736 aa, Artificial Sequence
  Recombinant AAV Capsid Protein
MAADGYLPDWLEDNLSEGIREWWALKPGAPQPKANQQHQDNARGLVLPGYNYLGPGNGLDRGEPVNRADEVAREHDISYNEQLEAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 189 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 190 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 191 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVSYQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 192 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 193 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 194 - protein, 735 aa, Artificial Sequence
  Recombinant AAV Capsid Protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELKKENSKRWNPEIQYTSNYYKSNNVEFAVNTEGVYSEPRPIGTRYLTRNL

SEQ ID NO: 195 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 196 - protein, 727 aa, Artificial Sequence; identical to SEQ ID NO: 176
  Recombinant AAV Capsid Protein

SEQ ID NO: 197 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQNVSYQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 198 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 199 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIGYHKSGAAQLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 200 - protein, 727 aa, Artificial Sequence
  Recombinant AAV Capsid Protein
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPFGLVEEGAKTAPTGKRIDDHFPKRKKARTEEDSKPSTSSDAEAGPSGSQQLQIPAQPASSLGADTMSAGGGGPLGDNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNLNSMLIWPGASSWALNGRNSLMNPGPAMASHKEGEDRFFPLSGSLIFGKQGTGRDNVDADKVMITNEEEIKTTNPVATESYGQVATNHQANYGQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 201 - DNA, 5393 bp, Artificial Sequence
  rAAV vector
ctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattctcagtccattaggagccagtagcctggaagatgtctttacccccagcatcagttcaagtggagcagcacataactcttgccctctgccttccaagattctggtgctgagacttatggagtgtcttggaggttgccttctgccccccaaccctgctcccagctggccctcccaggcctgggttgctggcctctgctttatcaggattctcaagagggacagctggtttatgttgcatgactgttccctgcatatctgctctggttttaaatagcttatctgagcagctggaggaccacatgggcttatatggcgtggggtacatgttcctgtagccttgtccctggcacctgccaaaatagcagccaacaccccccacccccaccgccatccccctgccccacccgtcccctgtcgcacattcctccctccgcagggctggctcaccaggccccagcccacatgcctgcttaaagccctctccatcctctgcctcacccagtccccgctgagactgagcagacgcctccaggatctgtcggcagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcctcgagatggattacaaggatgacgacgataagcctggtgtgactgttctcaagatgccggagccagggaagaaaccagtgtcagccttcaacaagaagccaaggtcagcggaggtgaccgctggcagtgctgccgtgttcgaggctgagacggagcggtcaggcgtgaaggtgcggtggcagcgggatggcagcgacatcaccgccaatgacaagtatggtttggcagcagagggcaagcgacacacactgacagtgcgggatgcgagccctgatgaccagggttcctacgcggtcattgcaggctcctcaaaggtcaagtttgacctcaaggtcacagagccagcccctccagagaaggcagaatctgaagttgctccaggagcccccaaagaagtccctgctccagccactgagttggaagaaagtgtctcaagtcctgaagggtcagtctcggtaacccaggatggctcagctgcagagcatcagggagcccctgatgaccctattggcctctttctgatgcgaccacaggatggtgaggtgaccgtgggcggcagcattgtcttctcagcccgagtggctggggccagcctcctgaaaccgcctgtggtcaagtggttcaagggcaagtgggtggacctgagcagcaaagtgggccagcacctgcagctgcatgacagctatgacagagccagcaaggtctacttgtttgagttgcacatcacagatgctcagaccacttctgctgggggctaccgctgtgaggtgtctaccaaggacaaatttgacagctgtaacttcaacctcactgtccatgaggccattggttctggagacctggacctcagatcagctttccgacgcacgagcctggcgggagcaggtcggagaaccagtgacagccatgaagatgctgggactctggactttagttccctgctgaagaagagagacagtttccggagggactcaaagctggaggcacctgctgaagaagacgtgtgggagatcctgagacaggcaccgccgtcagaatatgagcgcatcgccttccagcacggagtcacagaccttcgaggcatgctgaagaggctcaagggcatgaagcaggatgaaaagaagagcacagcctttcagaagaagctggagcctgcctaccaggtaaacaagggccacaagattcggcttactgtggaactggctgatccggacgccgaagtcaagtggcttaagaatggacaggagatccagatgagtggcagcaagtacatcttcgagtccgtcggtgccaagcgcaccctgaccatcagccagtgctcactggctgacgacgcagcctaccagtgtgtggtggggggcgagaagtgcagcacggagctctttgtcaaagagcccccggtgctgatcactcggtccctggaagaccagctggtgatggtgggtcagcgggtggagtttgagtgtgaggtctcagaagaaggggcccaagtcaaatggctgaaggatggggttgagctgacacgtgaggagaccttcaaataccggttcaagaaagatgggcggaaacaccacttgatcatcaatgaagcaaccctggaggatgcaggacactatgcagtacgcacaagtggaggccagtcactggctgagctcattgtgcaagagaagaagttggaggtataccaaagcatcgcggacctggcagtgggagccaaggaccaggctgtgtttaagtgtgaggtttcagatgagaatgtacgcggcgtgtggctgaagaatgggaaggaactggtgcctgacaaccgcataaaggtgtcccatataggccgggtccacaaactgaccattgacgatgtcacacctgctgatgaggctgactacagctttgtccctgaagggtttgcctgcaacctgtctgccaagctccacttcatggaggtcaagattgactttgtgcctaggcaggaacctcccaagatccacttggattgtcccggcagcacaccagacaccattgtggttgttgctgggaacaagttacgcctggatgtccctatttctggagaccctgctcccactgtggtctggcagaagactgtaacacaggggaagaaggcctcaactgggccacaccctgatgccccagaagatgctggtgctgatgaggagtgggtgtttgataagaagctgttgtgtgagactgagggccgggtccgggtggagaccaccaaagaccgcagcgtctttacagtcgaaggggcagagaaggaagatgaaggtgtctacacagtcacagtaaagaaccccgtgggcgaggaccaggtcaacctcacagtcaaggtcatcgatgtcccagatgctcctgcggcccctaagatcagcaacgtgggcgaggactcctgcactgtgcagtgggaaccgcctgcctatgatggcgggcagccggtcctgggatacatcctggagcgcaagaagaaaaagagctacaggtggatgaggctcaactttgatctgctgcgggagctgagccacgaggcgaggcgcatgatcgagggtgtagcctatgagatgcgagtctacgcagtcaatgccgtgggaatgtccaggcccagccctgcctctcagcccttcatgcctattgggccccctggcgaaccaacccacttggctgtggaggatgtgtcagacaccactgtctcactcaagtggcggcccccagagcgcgtgggggccggtggcctggacggatacagcgtggagtactgccaggagggatgctccgagtggacacctgctctgcaggggctgacagagcgcacatcgatgctggtgaaggacctacccactggggcacggctgctgttccgagtacgggcacacaatgtggcaggtcctggaggccctatcgtcaccaaggagcctgtgacagtgcaggagatactgcaacgaccacggctccaactgcccagacacctgcgccagaccatccagaagaaagttggggagcctgtgaacctcctcatccctttccagggcaaaccccggcctcaggtgacctggaccaaagaggggcagcccctggcaggtgaggaggtgagcatccggaacagccccacagacacgatcttgttcatccgagctgcccgccgcacccactcgggcacctaccaggtgacagttcgcattgagaacatggaggacaaggcaacgctgatcctgcagattgtggacaagccaagtcctccccaggatatccggatcgttgagacttggggtttcaatgtggctctggagtggaagccaccccaagatgatggcaatacagagatctggggttatactgtacagaaagctgacaagaagaccatggagtggttcacggttttggaacactaccgacgcactcactgtgtggtatcagagcttatcattggcaatggctactacttccgggtcttcagccataacatggtgggttccagtgacaaagctgccgccaccaaggagccagtctttattccaagaccaggcatcacatatgagccacccaaatacaaggccctggacttctctgaggccccaagcttcacccagcccttggcaaatcgctccatcattgcaggctataatgccatcctctgctgtgctgtccgaggtagtcctaagcccaagatttcctggttcaagaatggcctggatctgggagaagatgctcgcttccgcatgttctgcaagcagggagtattgaccctggagatcaggaaaccctgcccctatgatggtggtgtctatgtctgcagggccaccaacttgcagggcgaggcacagtgtgagtgccgcctggaggtgcgagttcctcagtgaccagggatccgtcgacgcggccgcttccctttagtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcag

The invention claimed is:

1. A recombinant adeno-associated virus (rAAV) virion, comprising a vector genome comprising an expression cassette comprising a polynucleotide encoding myosin binding protein C (MYBPC3) operatively linked to a promoter, the expression cassette flanked by a 5' inverted terminal repeat (ITR) and a 3' ITR; wherein the vector genome comprises at most 4.8 kbp; and wherein the expression cassette shares at least 95% identity to the polynucleotide sequence of SEQ ID NO: 95.

2. The rAAV virion of claim 1, wherein the promoter is a cardiac troponin T promoter.

3. The rAAV virion of claim 2, therein the cardiac troponin T promoter comprises about 400 hp.

4. The rAAV virion of claim 3, wherein the cardiac troponin T promoter shares at least 90% identity to the polynucleotide sequence of SEQ 11) NO: 3.

5. The rAAV virion of claim 3, wherein the cardiac troponin I promoter shares at least 95% identity to the polynucleotide sequence of SEQ ID NO: 3.

6. The rAAV virion of claim 3, wherein the cardiac troponin I promoter shares 100% identity to the polynucleotide sequence of SEQ ID NO: 3.

7. The rAAV virion of claim 1, wherein MYBPC3 shares at least 95% identity to the amino acid sequence of SEQ ID NO: 103.

8. The rAAV virion of claim 1, wherein the polynucleotide encoding MYBPC3 shares at least 95% identity to the polynucleotide sequence of SEQ ID NO: 86.

9. The rAAV virion of claim 1, wherein the vector genome comprises at most 4.7 kbp.

10. The rAAV virion of claim 1, wherein the vector genome comprises 4.7 kbp.

11. The rAAV virion of claim 1, wherein the 5' ITR comprises a sequence that shares 95% identity to the polynucleotide sequence of SEQ ID NO: 96; and the 3' ITR comprises a sequence that shares at least 95% identity to the polynucleotide sequence of SEQ ID NO: 97.

12. The rAAV virion of claim 1, wherein the expression cassette shares 100% identity to the polynucleotide sequence of SEQ ID NO: 95.

13. The rAAV virion of claim 1, wherein the vector genome shares at least 95% identity to the polynucleotide sequence of SEQ ID NO: 102.

14. The rAAV virion of claim 1, wherein the vector genome shares 100% identity to the polynucleotide sequence of SEQ ID NO: 102.

15. The rAAV virion of claim 1, wherein the rAAV virion is a serotype AAV9 virion.

16. A pharmaceutical composition comprising the rAAV virion of claim 1.

17. The pharmaceutical composition of claim 16, wherein the vector genome shares at least 95% identity to SEQ ID NO: 102.

* * * * *

UNITED STATES PATENT AND TRADEMARK OFFICE
CERTIFICATE OF CORRECTION

PATENT NO. : 11,129,908 B2
APPLICATION NO. : 17/210882
DATED : September 28, 2021
INVENTOR(S) : Laura Lombardi It is certified that error appears in the above-identified patent and that said Letters Patent is hereby corrected as shown below:

In the Claims

Claim 3, Column 63, Line numbers 50-51:
"The rAAV virion of claim 2, therein the cardiac troponin T promoter comprises about 400 hp."

Should read:
--The rAAV virion of claim 2, wherein the cardiac troponin T promoter comprises about 400 bp.--

Claim 4, Column 63, Line numbers 52-54:
"The rAAV virion of claim 3, wherein the cardiac troponin T promoter shares at least 90% identity to the polynucleotide sequence of SEQ 11) NO: 3."

Should read:
--The rAAV virion of claim 3, wherein the cardiac troponin T promoter shares at least 90% identity to the polynucleotide sequence of SEQ ID NO: 3.--

Claim 5, at Column 63, Line numbers 55-57:
"The rAAV virion of claim 3, wherein the cardiac troponin I promoter shares at least 95% identity to the polynucleotide sequence of SEQ ID NO: 3."

Should read:
--The rAAV virion of claim 3, wherein the cardiac troponin T promoter shares at least 95% identity to the polynucleotide sequence of SEQ ID NO: 3.--

Claim 6, at Column 63, Line numbers 58-60:
"The rAAV virion of claim 3, wherein the cardiac troponin I promoter shares 100% identity to the polynucleotide sequence of SEQ ID NO: 3."

Signed and Sealed this
Fourth Day of February, 2025

Coke Morgan Stewart
*Acting Director of the United States Patent and Trademark Office*

CERTIFICATE OF CORRECTION (continued)
U.S. Pat. No. 11,129,908 B2

Should read:

--The rAAV virion of claim 3, wherein the cardiac troponin T promoter shares 100% identity to the polynucleotide sequence of SEQ ID NO: 3.--